United States Patent 10,046,015 (COMPOSITIONS COMPRISING BACTERIAL STRAINS) - sequence listing, part 2

SEQ ID NO: 6 - DNA, 251926 bp, Enterococcus faecium
catgacgatttcactccctttcttgttgtctgccttgttgaaacaatatggcacgtttttgctttctgatttcttgttgctggatctcatgcttcaattgatcgttccaatcctttttcacttcaggtacaaattcatgttcatgatttttatagcctttgtagtattgttctgctttataagagaaaagaatctgagcattaatatcccctttttcttgataaaaacgatcaaaatcgtacgtaccatccacgcgttcacaaccttttaattcttttgcgacttctctacaaatatctttcaaattaatagcttctattgaatcgttaacagaaagctgctggtcaaaagacgcattgactttgtgagcggaaaccagttggttcgttaattgcagattgttttctgtcttgtgtatggccataatagcttctggtgtgaccttttcttcttttgcgacttcttcataaatgattttgtattcttttggcacttgccaatcattagcgattcctcgttcacaatgtactttctgattcgtaaatggatcgactgcgcccattaattgttccttttcgtagaaaatatgtcctgcacgatcattatccacacaaatctcaatcgattgaggaaaggcttgtttctttctcaattcagatactgcctcaccaaaataatgactgatcacatggtgttttaacccttccatagagactaaccacgtatcgtttaactgatcacgattcagtgcagcgtagctaagtaaatcaatactactctcaaaaaattttaactgcttagggtcaccgatctttaggttaaagccatgattcgctgtcgaatttttatctatatgcttatatgttcctctctcaccaaaacgttcataatcaataaacgttccttgataactcgcccccacagtctcttttgtctgtggatctttccataaaaaggcaactgcatgatctaaacgattgtctcgaactaaaaaattttgccgttcatgttttggctttagttcagtaatcaatccttctttttctgcataatcaatcagccactctggcaattttcgttcttccttcagataattccttcctttttctgtaagtggttgataatcaacggggtgatctttgtacttttctgtctcaaaatgaagattttctactcgttctgttttggcttcattctttagaataaaatcagtggctgctttaaattgttgcttagggtcttggatctctttgtctataaaaaaaagtttagctaattcaataatgtcgccactaatattttgactattccaataaaaacgttgttttcttcgatcgaaaacaaacgaatcatggtcttctaagcgatagtcacgtcctttattgactacagccattccattgtttcgtgcaaaatccacaatatccatttgcttgcatcgatcaatgagactcatttttttctctgtcattttcaaacctcccaaaagaaaaaagactatccatttttcagatagtctttcttacttgttttatacgcgttctttttgtgacaattgttgttcataatagatttcattttttcgtttggccacttctgacactgtctcaagtgaaaatcggaatggatttcctagcgcaaattcttctgaaggtaacgccgtttggatctcttttccataactttttccttttaaaattacttgattatgctgcggatcttcaataaacaccgcatccttcaaatgtaacgttcgacccgtatcttcttccattactttcccgtctttcttgtcgatccaaagtgaaccaacaggcacaatattcttttgttctgccgtttctacagtatttttatgctcctgctgcacttctgcttgttggatctctggttctctttctctgtattgattgatttcattagaaatggtttgaatgaattcatttgcgacacggctgacatcattcatgattttcccacgttccgcagcttccttatcatccaacgtctgaccattcttcgtccatgctgcaatataaggaatagctttctccgacgtgtccattccaaaatgtttgcacacaatataagaagtcatttctgcctgcaattctttggttgcggtgtctaattctgaaaatttgtgcattcttgcatgggctaattcatgaatacttgtagctaaatgctgcgtaggagtatttcgagtattcatcacgatttcttctgcaccagtgaccttgtcatagacataagccccacgtgtttgtcctaattctctttgatagatttcgctctccgtcatatctcgaatttgaattccaatattgttggctaccgcttgaatcccagcttgaagttctgactgacctttagcatccaattgaaaatcaaagacacggttcgggaagattttcggatagtcttcaggcttcaattgtgtttgtgtgatatcaaacactttttcaatcgtgtagtaaggctttttgatcacttcgatttgaccacttttgattcgttttttatcttctggtgtagcttctgtttctcgaacaaaaccacgtcctttctcataaaatcctttgaccgtttttctgacaaagatcttgttcccttgttccccttttttgatatagattccttcttttttcaacgcggcacgacctaaacaagccgttgcgcctggaaattgttcctcgatcaataattgatttctaaaggatcgttctggaaaacgcgacataaagttcagaagttctttcacgccttcaggagaatgggtatgctttttcaccgcgtccagtgcctgttgcgaaagggatttgacttcttgcttaatctcttctgccgttcgtttttgatagcccttttgttttgtttttgtttctttcgactgcatttgttccttcgaaacagattcattttttaccgtttgtttttgttccttttcaggtacttgttcgcacaattttgctaactctaaatagatgggttgattactgttgacgccatcccctagatccattcgaatctgatccactacttctccgttcttcacttcttcaaaatagaatttataataacctgcttctgcagcgtattggttatccaacgttttaagttgatcgatcaattcgaatgttacgatctccccaccataacttttcaatcctttttctggatcattttcgttgaattctactcgatagaaatgatcgttttctttctccttcagagaatcagttggtgcagcctcttcaagtaattcacgaacagctgctttttcctcttccgacgtggcttggtatttttttgattcctcaaattccccgttttcattcagttctaaagcaacttttcgatagcctttcaaaaaataaatggttggattttttttccattgcgtcactcgtccgctgtcaatgatcgcttgtacttcagggaggatattttcttttcctttttctgatttttctttcagctgttctaatgtttccaacttccgttggtattttcggatcgtagcggctgaaaaagtcgattcacctttttcaaagcgttcgatttcttctttgattcttggaatattatcgattgtcatatccagtccgccgtacttgttatagcccatttcctttagctcttcttgtctttcaagcttttccacgtattcttcttgttgcttgatctcttctctcagactttggactttattttcgattcgttcttgctggttaaaccatgaacggccattcctcttgtcgttcattggttgaccgttcgtcattttttggtgttcaaacatcttttcgatttgttcgtttaattcattttgcaatcgtactaattttcttttggattttcccaaacgactattgtctagtggttctttttcttctgccatgtccgtttcctcctcgtaaaatatcgtttgtctaaacaaatggataattttctactgcatcgacgaacgtcttcgtggtcagatttaacgcgagaatatcaccactttgatacgcttttgccgctttgtctgtaacgacaaaagctctgcctgtttgaatttctgtcacaaaaacgagattatctctgcttttttcaacaacaactccgatcgttgaatgaaccatttctgcttcctcccttctctttcttttgatataatgtagtcgcaaatcgcaccactcaatgaattggcggaaaacaattcattgaaaaaagagtcctgaacaatcacgttcaggactcttttacttcttttattcacttaacaattaacattctgtgagtgaaatagactcttcaatgcttttacatggaaagttattgatcccctctgcattcatttcccatgtagtataataaggaactaacttgtcctcatattcttgaatgataaaatatttttcaccgttcacatgattacaacaatatacgccagtagctggatactcaacgactaaaaattgatttgggtcaaaccgttcgatgctcaacatttctcttatctgaaacaaatgctctttttccaaacaatcgggaagtcgttcgattcgttcttcttttagtgatccttctatgactttccactgatttaaatatcgtttcattgctattcctcctactgtctttactgtctttcttgttccatttgaattcttcgttgttgctcttcgtatgctttacttgcgtggtatttttcttcatgggcattaatcgttcgatttaattgacgtaaactccgttgcgtgacaactctttgttggaattgtttccttcgcttcatgaattcttcgtaactatacttgtattcattcgttggcaactgtttaagtgttcgaaaggatcgttcattgtaaatagattgcatctgatccattctttctattaaaggttttatttgactatcctgtttcttcagttctgttagaatggcatttcctgtgcgcttcttcaaatcaaagagagcatttttttctgcctcctttgattctctcttgctttccccataaagattttttgcttcttctttcaatgcttttgaaatctttatatattcttgatattcaggttcttttgttaaaacatacttggttaactcatcgagtttctctcttgtgtatggtgaaagtttggttcgtttttcatccccataatgccattccgaacgtttgtcaggtaaggttttatatacttcagttaataagttcattgcgtgtcgatcgtaacgcgctggctcttttaccacttttgttaagctgttacgtaaatcactttttcgtgtcaataaatttcgtttctccatcccaatcattcgattcttttcataagagaaaccttctaactcatgcacataattggttttcattgcatctaatgttgcttgtcttctcttaccttttggtacgatataactcacaccattttcaacctctgtgtaaggtttacgcgtattttctttttcaacaactgcaaaatgaatatggatatgtttggtattgcggtgaatcgttgccatccagtagcctgtttcattcagttgctctttctcgaataatgtctccatcatttttcttccagctgcttttaatccttcttcatctaaagtatctgttttgggatcgtacaatcctattttttcaagatacgaatgatcatgagagacaacatcttgataaatgattgatcctttttgttgccctctttggaagatttgcttaatctccttcagatcactccctttcacttcgtctgaagccatagaaaaaactccaggaaggtttcctgaagcctttttgtgtggctctgtttgatatttttttattgcttggttcaagcgttggtattctttttgttcactttgcgtcagttctttcttttgttctaacgcatagtgacgggtcatataagaaagatatttggtaaaatcttgctcctctaacttgtcaaagttgattccatttcccatcaacgattgagcttcattcgacgtttcgctgaattctttatccgtcttactctccgaaaaagtttctccttcaggaatataaaaatcctctaaggcattcttgattcgttgcagttcctgttcttcgtcgggcgtgcgtcgttccttttcttccagcgctttttctcttgtcatataatcaatgtatgttgaaaaagattttttattgggcaaggtaaattgacaagtgagaatgactgcaggcgatttattcatcatgttccccttctactttttatctttttaaaaactttgttggatcaaacgggtctactctggcatgaacagattcatttattggtttcttgatcttaggagaatactttttcgtttgattcgcttttattttcccttccacacgctcttttgcttcttgatagacagttgaatttgtaccaattagtattcctgtatctttcaaatgaagatctgcaaactctgaaaccatttcggttaaaatagaaatttcctttcccattgcattcaactttgcgttcgtcatactattatttttttcaatttctggatcgtaattcatacataaaaatcgaatggcttcagaataattttttaccgtaggttgagtttccataatatgttttaaaacttcatcgtgcgcttcataaaatgtaatatgcttttctatcgctttaaccatagaacattatctccttcctaatgtgtgattaatatttcaattaagttcttgacctcattcgtgtatgcttccaaaacttttgtattatgcagctgaacatctgtaaatttttccaataaacgatcaaattgatctttcttgtagtccattaaaggacgttcaaagtcgttttcaatcaataattttaaatagtcattcctgctccattttgagtctgttttttttcttaactcttcacaacgtttatcaatttcattaatgtacttggtattaatatctctgataatgatatccatatgattctcctttttacattatggatagtctatggatagtatccacaagctatccataatataggtatttgctatccacagactatccatgaaactcaatttttgatatcaaattttttccttagaaacgtggtaggcacagcctacctagcacctttcgtaagaaagtgatatcacgtttccttatgctctttaaaaattaaggttatttgtgtatttagacaataaaaaatccttctaactttgtcgattagaaggaaatattttgtcatatgaaaaatgaatttaagaaaaagtgtatgctataattgatacgctgtcttcctgtttggttgaaatcttcagccagaaaggaggagtgttaaatgttttatgtgcttgatgtttgcgttagaatcgtggttaatgttttctcccatctcattaacaaatggttagattctaaacatgataaagacagctagcctgttcattatttggttaatagtgaataaagaaaagagccttacgcagctgcaactgctagggctctttttgagtattaaatgttttatgtgtttgcattatcagtatagcatacacttttttcacagacaactttctacattttttcttcttttttcaatcaaaataaactaatgaataatataaactcttattgagaactgttggaaatgattactgatatcttcaaacaaatgattcaaattgactagactcattgaatctcctcttcttccataggaagctttttagttacttctaaagcatcacttttccagccaatatatggtttgttttgtggaatatttcttccatttaacgacaattttccaatgccatatcttagatttgcttcgacttcataaaaattgtagacctcttttcttcggtcgattgctttcgtctcctggccatcttttaacgtagttctgatgcccttaacggtagcttcatggatactcgtgtgaacaatatctgtattgatcaattcgtcatatcttccaaaatcaacatagtactcataaccaagaagtgtcggaatcaagtcaatctcaatttctttttcaattgaacgtttaataagtttcgtggatacatacccgactaaaaagagaataatacccacttcaaacaaatacatgtgcccatttacaaagtgaacaaacgtcattaaaaattccttcactccttttgttgttcttccaaattgttcgatttgttttattaaagttgctagaattgcatttacaataattaaatcgaatagacttttgaaaagttttcctgctgttaatttttgcctggtaaattgcatgactatttgagtaaaaatagacaatagcatgacaaaaatcaacgtcattagcactgtaaaaatgtctgatgctgcaatcctattgggatcatttaataagtaataagccgttccaaatactacaatcgagtaaatgattaaatcaagtataaaacgagccaaatagctacaaagtttacctaatggccataattgtagaatccaaaattctttacgtttgctatttcttttcaaaggaagccaagtgtgtttgatccagtcggtcgattttatttcaatttcttctctcatttctttcttcttttcttgccaacgagaaggcagaagtttgttgatttctgtccccaacaaaatcaataggacgcatgagattacactcatgagtcccttcaataataaatcttcattagtaaaccatagaaaaatcgttcccaaggtcacggctacaataaaaaagaagccaacgatacctacggtgatatagctgatccataaacatttttgatacacttttttcacataaaatcctcctgtttttattttctttcagccgtaaaatattttttagcagctaaatacaaagcttcaaatgatctgaattttaaggtatctaaactctttctaccattcttcaactcagatattgttgtgttagataaattcacttcttgacatatttctttagcttttacaactttgagataggctttaatcaatactttctgctcagcgaaagtatctttgccgaccaagttcgctcgcttcatttcttttactccacctattcttctaaatattttcttttgtcatacgatcaattttttcttgaagtttttgaatgatctcttcttgatctttcatttgcgttttcgatgtttcaatttcttgctggtaactattaatcttattttcagtattttcctgatcgtctgcaacttgataaggcaattgatcttttagtttcttcactaattcttcattcaaatcaatggttgcttggaaggattcaatctgtttttgtgctgctttttgttcttttttgtatcctttcactttgtaattgatcgcatgttgttcataatcttcatctttcacttgatctttaaccttatcttcgtgaacgtaataaatcagatcttgcggttcttgcatatccacttttggatcaattttttcaggaataatggttaaacgcatggcaatatattcttctggtacatgagatagcttcactgcaaaataatcatcagacactttgatcactttggcttttattgcttgataatcccctttagctgtctttacttctacgcgataattaagattagccagttcttttaataagctttgatcttcatcgtcgattgcaaattcaaaaactaattgctggttcgctcctttttcttttgaaaccatcgtcagttccttcgtgtttacaaatgcgttcgtgcttacctcatctggtatgtctaccttcttatgcgtataaattggactagcaagaatcaaaaagccgagaatcataaagatccccagccatctaagataactttttcgttttttgaaacgttgtcttgctccttttttcttactcattttcttcctcctaacgagtgaaataactaaagtctgtgactttccattgaccatctacttgtttttcagtgacagttaatccaccttttattttttgcggtttgacatctttgaattgaggattgccgattgtataatcaacaaatacgacaagattttgttcctcttttacactgcttgtttgagcgtaagtttgcacgtcacctaatgtaaaggagtaacttccgtaatcatcatgttggtgatcatcgtctgcaggacttaatttgtcgatcacttcttgggttgcgacatcttttagtttttccgttaattcatttctgcttaatgatttatcaatggccaattgaccgaactcttctgccgtctttctttgtgcttcagttacttcctcttttgcttttgtgccatcttgttgcttcagctgatcgatttcttggtttttctcattgatggtttgatttaacttgtcgatcttcgcctgtgcctcagaggaattttttttgagcttctcagacgcgtttttagccacttcttcaattttaaaggtatttgtctcttgttcttctttcagctgccaaaacaacgcgatattgccgattaaactaacgctaattgcagctgttaagacgatttttaaagttttattttccatattttttctcctgatctattttttgctgctattcaaaaatggtaatggatcaatccatgtaccatcgtctgtgaatgcgtgtccttgtgcttgacgccaatccattcgagtgaaacctaaatgcaagtgtgctgtatctcgtatcccgattacttgaccaactttcacttgatcgccaaccttcacacgagaatttcctgtactattcgcaaattcttgatataccatattcaaaccgtcgtaattaatcacgatcacacatgcacctaaacctgaaataccaggattgccaacgtacacgacttttcctccatgcaccgcgtgaatttcacttcctggatgatcgactgaaccaaagtctaatccatcatggaagccattcggacggaattcaccgcctggatttgttccaaataattgaccaccactgaaggaatttttatctaaactgctgccagggaatggattcgtccattcaccagtgatcgtgccgttgttattgccaccttcaccccaatgtttgatggcgaattcatcatattcggttaatttattagaagtgataatggacatacatcctgtataatacggactatcttccgtaattcctgcagcggcataaccgcctcgtcctaagatcaataaacttgcgccagggcttttatttcctacacatgcattaaaattggattgtgtggctaccataaagccgtaatatgagaaggcagcttttgagttgggaaacttcatgtaccagccaccttcaatgccaccaattcctcgtgcagttcctttaggaaacagacaaccatcaaaccaagtaatcccaaaatagttgagatcatttcttgcggacgccgacgtaccaaacgctgattcataaccgtattgcgaaaggatcacacttggtaataatttatatttcactgctgcacctacagcatattgcgcaatctcatcagaaaaagggcctcttcctttgatttctttataaatcggtaagccttccgaatattctcctgtaaaagcttcgccaccactacttgaatctgaatcagaattatcaatcgaacccgccgcaagtattagaaaaagggtcacgaacacagtaatcaaacctgcagaagtaccaaacaaccacaaaaataagcgtcgctttgcacgacgcttaacatactgcttgattaaactttcattttgattttccattattttcctccatcagacaattttaattgacgtttgttcggactaaaatgaacacgaatggtttcttttgagccaaaattgatcacagcgtctccttgattttgttgaggaatggattctaattctgagtttgtcattgatttaccaactaatccttctatatgacgtaaaatagattcatccatacgcataaagatcttcgtagaagaaaattcaaagactttcttcagtttcgagaagttatcagaagacatattttctggcaccatttcttgtggggattgtgtagctaaaacagtcattgcttctactttacgcatttctcgttgaaagtttgtgacataatttaccgtttcaataaaatctggattaatcgcattatggcactcatcaatcatcgccaagaagcatttgaagtcttgttcttccatttttttttctttaattaaacgtcgttgtcttcttccttgaatcaatgcctgattccaaatcaacgtcatagccatgtacatttgacattgttgtaccccacgatctaaacctgtaatagagtcaatgtcaaaaaagaccaactgttgttggtcaaggtgtcgaatcgtactatgaccatcaaaaatcatgccatacgtctcacataaggattctacgatggattccatttcttcttttcgattctttttctcttgggaagcacctggtaattccagttgtcctaaaaagtctaaaaattctttgaacgtcggataagcttctggatctttccctgtgacttgcgtctccgtatttgaacgcgagtttgaggaagtgaaaccgcgtggtactgttccatactcttcataaaaacgatttaaataggtcttaaattctgctttcatcgttccttttagctgaggactcactaactgtacctgatagaccactttgtctaagtgcgtttgataggacgctgcttcattgatcttcaaatctttgactgatccatcgtcatataaactggaagcttcatcatacgtacgtgtggcaaatatttctaaaggattgatcatcccgtcagatccgtctaaacgcaccataatgccgttatattcctttaaaaagggaataaagtcttttcccttttcaaagccccaaataaagtctcctgcagctaaatgggcttccgcgatcattttaagaacggtcgatttaccagctcccatcattcctagaagcaaggtattggtagacaaccgcacactatttttatacgtggcattccaaacaaacgggccgcctgtcatggtttccccatattgtgttccacctggatcttttagcgtttggtggtggaacgggaaacctccgccaatgtttagcgatggtagtgattgccctttgatatttccaaaccattcagcttgttcatcgaacatggtgaacatcgattgccagtctcttttcgttttgtgcagataggtcactgcacgataatccatccctttgagattttcgatcagttcctgtgctcgttcatctacttcttgaatcgtgtttccgtaaacatgtactctcactttgacttgtttagaaatttccccattagaagtcaattttcgggcatattccgctagttctaggtattcttccgcgcttttatttcggtcagtcgcttttcgttcattatctgaccgatcatttaattcatctaaggcacgattgatttgatcaatcactttttgcttttcatctgtgctaacatctagtgttgccactgtatgaggattgttcatgagattggccaaccaaaaaagcgtaggattttttgtgtagtgataaactgtcacacatcgtgaataaccatttccataggtcacatactcttcatcgaaatttaatccaccttgtggcatcacttgttttaaaaagtctaaatcataccctttggattttaaaatttctatttcccgatttcctagttgctttaatggatcaagtaccttttgatcattttgtggtgaaaaagctgttttaattgcttctaacatgtacagtcacctcttcttgtttgattctttacttggttaaaagattttccttttcccaacttacccaggcttaaagtgtgaggaaattttctagtggtctcttctttcggaacatctttttctaaccatatcaacggatatttcattctctcttccccattcctactcatcattcatattattcattcgataaagaatcttgatcaattcttttttgtagagtggttttaaccctaaaatgccactagatcgcattaactgacggtttctggtttgcaaatccttgattgtctttccttcaatgacgaaaaagaagcttaaatcagggcgttcctgttctgctcgtttcaattcctggatttcctctactaatttcttttcatattttcttaatcgctgtagatttcttcctaaggactgttccatacgatttttatctaataactgccgcttttgcacgatttgctccattagatccgtttctgtggtcaaactaactaacttaatcgttggcacatacgtacgcatgacagtggtcaactgattcattcgttccagtttctcttgttcatttaatccttccacatctgtagaaactacacgataataacgttgaaaatgatcttctttagtaattaagactccctcttctgtacaggatttataaggaaataagtccaagatagagcgctcttctggttttccaaactgcaaaatggattttctgtcaactgaattttgacctttgactcgcatttattcatcctccttatacgtaccatgataatttcggttaggatctaacgcatgataatggttcttgtccgtaaaaaaaatagactcgataatcgcaaaaatttgtcgttgacctgggttattatagggtcgccaaacaatcactagagctatcgcaatccataagccataattcaagagtgcaaaaaagagtggtaaatggacaaggttattgactattttcgcccaaaaaaagcaaccaccaagcgttaatagatccaaaaagaaaaaggcaaaaaacttccattccccactaaatcttggaggatttttcatgttaatatatttatccataaatgatttctccttttcatacatagaaaaaaggcctaacttgtaggccttttatggtttgatatcctgtttgatatccctcaatagttgttctttcaattcattgttcctgtttttagtttctcttgtcacatttatttttgttggtgcagtaaatgccacatttgctggtttgtaacctgtgtgaactctttgaataggttctggtgcagcttctcttgtcacaacattttgaacggacgcattccctgtctccccactttcagataaattgtaagaaacagttgtcagatttccattttcaggcaaacgacttggtttcatttgaacattacctgcagttgattggtgaacaaagctttgatcattctccttgaattgattcaaacgactatctttcattggtaaattttgtgccttaggtaaaccaattttcgttgatttttcagttccaacttcgaccccattatcatttggcagatcgatggaatcatcatccgtttgtacttcttgatttcgttttggtaaatctgaaatgcgcttttcattttcagaattaatgttagatttataacgatattgttctggatctgtttttggtaattgaccattttgtccttcttctgaattttcgttagaatgcaactcatcttggtgatctttggctgaaggaatcgctgcaccttcttgattttctttttcggttgttgtattagcttttactgctgcattgacttgtccttcaccatacgcatcttttagtccttctttgacttctgaagctttttctttttgtttttctagtgtttcggatggattcttcacagcttcagccaattctttagctctcgtgccgtctaatttctcttctaaggtgtctttggctttttctgtaagatcttcagctgttccttttaacccacgttcattgacgtaaccaagaccttctgcggctttagaaacaccatttttcgctttcccgaacatttcggaaactgttttcttactattaggtacagttgtagctttatcgtctgattgttcttccccgttatcaggggtaacatcttttcgattaccaaatccatttttacgaatatcatttaaattgcttaaaccactcttaccagcacttgcaaggtttttagccccgctacccacatttttcgcaatatttcctaaggcaaacatgctaagaagagaattgctgccgtttttcagactcgtatcaacgccgaaaattttcgtaactgattgagagcctttgaatagcgcaatggttaatacaattaaagcgacaacatacaagaatccattgatctttcctgccgcatgcaaatcaccgatacctgaaagcattaatgtatagattcgtaattctaaaatcgtaaatgccaataacaagaaggattgagaaatatcttctatagcacttttcatccgttgtcctgtctcaaagtccgttgacgcggcaatcactaaatagaattttttaaataccagctcaataatgcaagtaacaatcgtaaacaagataaataaataggctaccgacaaagaagattcaccagctaaaataatacctggactactaatgtatcggcgatagcctgaagtatacacatattttgctaaaccttcatcactaatttgaacagggatttctttcccattatcgtctaactctagtcgatactgtaatgcctttaaccgatctttttgtactgtactaatatcacttgattcagacattttcttagcttgatcaggtgtaataatcccattgatattcgctgttttaaaatttttcgccgtgagagcatttcttttgtctgttggtatgtgttctactttgttcggatcattttctagtaacgtactcacatcaatcacattattttgaataatttgaaaagcaggtgaaccagttttatctgctttatttgctgcagtcacgtctccgtaaaagtttttactaatatttagcccttcatcgattaaagaactaccaccaaaaatcaaaatcatggccataaatagattaaccaagatatttttgatttttggtggatgtttactcataaaaaattttaagcctaaataaattaatgtgacgacacaaaaaagagccaataccttactaatcaaactttgaaacagttcattaacaccagcggcgttcaataagtcttttaaatcaaagctttgataaattgttttttctagtaaagtattgagattatataaccctttaatcaaaccccataaaaaagtattacaaatccaactgaatacatcttgatactgcagataattaccataatcttgtaagactttcgttacggttttgggatctgcatccccatccccaaataagcctgaccaccagtcggcaatgccggaaaatattcctccaatgatcattctttcaccgccttttcagcttctagcaaaagtcgtttccttataacctctgtaatttcttcattttgacgcaatttttcaaggtattcttgcaaacgatctatttgcttctcttcataaaattgaataagtaacttttgtgccgttgagttgtctaaagattgaacgattttaataaaaatgttttctttagcttcctcttctatttgatcgtgcatattgtgataaagtcgacgtgcatagatatcaggtagaaaataatcgtaatcaatttgtaaagccttaagatccaagtccgcatgtgtacaatgtatgtctatatcattgatatcccacgatggattgaaatcttcaatatattgataagcataaggaagattcgtttccccatgattaaaaataggatacggccgtattttatgacctttcaaatcttgtcgttttaaaggagcgagtacaatcgtttcaccttctaaaaaagtagaaattctttcaggagttaagatgcgatctgaatcaacattgcgattgatatgagtattcatacctaatgaattgatggtactgttctcttgttcaaccgtcttattccccacttttttggaaaattcttctatggtattatcgtctgtcgacataatataaatatgtgtctgacaattttctttgataatcgctgcgttttgttccccatacttcgcataaagttgctgataggattggataaacaaatcccacaacatgtttctaccagctgtgactgtcatgattccttccatattatccattggtggcatattcccaaattcatctaaaataaaatgaatcctacggtgacatttatctcctttagtcttaacacattgcgtagataattctttatacaactgactaagaaaaatactaacaatgatatggttagatggatcataatcaggtgtgagcataaaaatagccattggtttatcggtatagtgcatccgaatagactctactaataagttacttttatcctcatctaatgttagaacggcttctttttctaattctggcaaatgggtttctcctcgtttttttcgataaacgatatttccctcttcgtctttcaatactctttgagaaaactcataccaagcaacatattcttttcctcgatgatcgtattttaagcaaacatgatctccctgttctaaatgacaattaaagttaatttcacaaaaacctctatagcctactttgacacgttcctcatgaaatttttttccttgatgataaaactctacaacaattcgctggtttaacagactctcgtgtagtttgagatccaaatacttcggaaaaccaatggacttataatcaatggttgattgagaagtcattttcgcaattttcgtcagtgtaaatggatttagtcctgtgatcgctgtcgatagaatgttgcctttcgctttatcagaaccaatttttgttgccccatattgtttttttgctgtgtttccaggtggtaactgattcataaattcatctaaagcattgagctgcttgaattcattatcaggatcttggtaattaaaaccaccaatctcagaaagaagttcgacgagattattcggtgttaatttggagtaatcccctgtctgatccgcttgttccaataacgcaaaaataagcgcattgacagctttttgcgcattttcgttaaagtatttattgtctgaagcgttggcatcataataaatcgtattcgtgaaagtattggttaactgtgtcgctgtgtctatgtctcctcgcttccagtatttcacgatgagtgccaatggattatcactcattgattgcagtggatcggtgatattaaatgcatacacatcataccctctagcttctagttcatctttactagcaacatataattctgtttttggatcattaacaaccattgaactttgtctttctgcacgagacaaattgtcaatggttgctaaaacttctatctgtcctttccctgaacgggaagtaccaacaatacaagtatttactgtatccgtctgaatataccagtactttttataatgagtaattggtattccgccataaccaggaaaacctccctttgattctggtatttgcggataaatttgttggatttcctttaacgtttttaatcggttatctcctttttgcccatctgctagaggacgaaaccacatgtccattttcaatcccataagtacagctggaacaacacaaatcgtagaaacaactaaacgtgtgcctaaacttgttgttggggtcaaaggattccaaaaaccagttgaatcaaaatggaataactgcgacatttcttgtaactgaaaaatattcactccttgtaaacttcctggaataatctcaaatcgatgaaatgcttctggtattcttgtaacaacatagtttaaaggaagataagctaagccactataaaaaatcttttgagaaatacgtttgtcatgtttttctggtagctcttctcctgaaggagtatagcgatagaaatgagaaagatacctattcttttctaaattgaatcgtttgtcttttcgtctcgttgtttctctaacacgcattatttcacctcatttgattctgaactttcggaagtgtttgattgtacagttgaatcgcttgatccttctttagccttactaggatcactctctttgctattttccatacttgattctgttgttgactgattggtacgattcaataattcttctaattgttgttcatactcttttcttgcttgttcttgggcttcttccttgattgacgtcgttgtggccacagaatcagcctgtgaagattgattgatatgattaaaagcaaatactgttcctccacctagaagcaagcttaaacttgcaatacatcccaccatccatccgttaaaggaacgctgtggtgaaggagttagatttgtttggttgttcattggggtttgaacagcagctactgaaggcgttggttgaggttgtgctagataatttaactgagcttgtcgcaatgtatccatttgttcttgacgttccttacgagcagctgcttctttttccttttcttggtttaaccgttgtttttctattgccatttgttgttccgcaagatcctgttcacgtttttttagttctaattgttcgcgctctttttctttttgccgttgtttttcttcttgttctttcaattcttgttgttgaatttcatactcttttttccattttggaatttgcacttgtaattcttgctggatcttttcgtgtttttccataagaacttcagtcgttgtttgatatagcttattcagttgttcatttaattctttgctaatctttagcttatctgtacgcaaacctcggtaaaattcttcttttcgttctttaatacgttcttttaacaagttttctttttctttcgataacgcttcttgattcgtctgagtaaaattattgatctttgctacacacaaggaatacgcattgtcgcgtttcttttcgtatcgctctttaattttttgtacttcttcttcaatcactcgctgttcttctttatttagttcctcttttgctttctcccaattagacgactgttccgtcgcatactcattaatttcttgatctgtttcttgttgacgttcttcaaaggtggctaataaatcttcttgtgcaagctcatgccaatttgttgattggacagactctaactgttctaaaagtgtgcctttaccctgtgagattaattcttctttactctctaaaaatgcttgataggtttggggtaattgatatttcgaataaagctcatttaaaaataatttgtttttttctttcatccattcatgctctggcggatattgatccaaaatataatcaaatacagttgccttttgtatctctatttcgtttttttctacttcttcactgataagtggttcaatatattcctgagaatccccttcagtccatgttgactcttcattagcttcaactggatcaacttctacttcggccgtctcttcatcctccattgtttcttcaaagggatctacctccaattgacccatcacatcgttctcttcctcaaatatcgatttctgagtcggaatatcagcttgttcgtcaacatagactgtctctttttcttttgactccttctttggaaatattggtcgttcccatggtacttcttcatttacttcgacttcactcccttgattcacttttctttggtcgctctctaactcttcttctaaaacttgtaaaagtttttcgtttcgataagactcttccacactcatagtttcatccgtttctttaaacacatcaaggcggattaaatccatcaatgtaggatagaaaccttctgaaatttgataatccagttgcccaaaaacgtattctgtaccagctttctctatttttccttctgtgtcatgtaacgtgagagtcaacttaacagaagatcgactttcgtgttccagtactttccctaacacatgtagctgttcttccgtttcaatgacagaatatttaattgttttcggtaaaaaagaagtacgctttcctacttccttcgttgctttttttattaactctttatctgttttggtattgcctgcaatcgtaaagtacatgagtattctcctttcataaaaaaggagtaaaaagtatcgactacttcttactcctacttttttactttcttataatccttgaggtgtttgtccaaacaatccaaataacgaaaccacaatagaagctgctgctaaaataactcctacccccatcaatacatagcctacgtgcatcttcccattttcagctcctcttcgtccaaataggaagaaaagacccccaataacaatggaagcaacggccgcagcagcagcaaaaatcatcagattgttttttaaactagttgcggcagtttgtaatgctctaaaaatatcaaccgcagctactactttcggttgtgttaaaaaattcattgtaattgattcaaacataaaattgttcgctccttttagtgtttaataatttcgtcgaaaacaagcttttcacgttcacgttgatagatatatccttctaagtccttgtcttttccccgtaataggtcaaattgtgctttttcaaggacttcttgtttccactgtgtttcagatacaccgcggcgttctaagattttagacgcggctttttcaaatggagttttagcttttgccactgtgattcctccttcaggacaaataaaaagactagcaatcactcgctagtcttttgtaacttatatttattggattgtgatccatcgtgaatcaatttctctttcgttcgcttttcatccttgctagatccaagaaaaattattttttttacgccattcttctcatagggaacaacaataaataaagaatcagatttgtttataaattccctaacaccagctgaatctactattttgtatctttctaaacctttatagtctttttgcctcttgactgttatttgtacaggatctggatgccatacactctcagagtattcccaggtagtctcgtctataattttcaaattataaacaagaccacctacttcttctttccacatagttcctgatttcaatacgccattatcttgattagtttgtttatttttttcattactacatccgactaaaataacaatcatggcaatcaaggaagtaactactattattaactttttcattttattcattctttcgtttttttattttaaatgtatctcagaaccgcataactaaaagttgctaacacaagtaatagtaagctgaccgctgaaatcgttactaaatgtgtagaacctgttttaggaacaatgacctgtggcaagttaggatcaaccccaattgtcacaacatttgttttattagaaacattatctactgctactacggcttggttatcaatatttttttctgattgtaatggagttttagctgtaaatatcagctgaatttctcgtccatctaaaagattgttacttaagaagtcagcggaagcttcccacttcagcgttcttgaattgctatcataggttagtgtgccttcagaagtaatatcttttcctttactcttatctattacttgcgcagaaccttctttatatgtcaaacgagcttcaattggatcttgaatactaaattgtttgtagtgatctgacgcagcgtctacgccttttgtgtgccatttttgtgtgactagatattgtacttcagatcctgcgtttaaaggagctgtcggcgtacccttcttaccgtcatttcgtccgtttacatcttttccattttgttgtacttctttcactggaattttagggaaataaacggtaatgatatttgtatccttttctactttattaatgatcgacgttccctgatttttggctacactattttgattggccaattcattgacttttacattgatcactaattcgtaagtttcgccgttatacttcattcgattttttaatgtatcagctttcgctgcatattttacctggtgttttgttttgtcataggtcacttcaccagatacatcgaattttttatttgtaccactttcaacgtgtgcatcgacgtaatttacttcttttggtaaattatcgattaactcaaatcgatcgtaaaccgctagtaaatccactcctaatcgattcaccttctgtttgattcgatattgaatcgtgtctcctacttgcaacattttatcgttcacgttatttccatttttatcaacccctgttttttcaggttgatcaggaacaacactaaagattgtcgcagaagataaagtaaaccaggtttgaacattagaagaaccaatcacaaacgtcggatttgcttcagatattttaaaggacacagtaccttgaccaaacttcggatctcctaatttatcatgcaaattattgaaatcattatccgcttgtgtcagcttagagcttcctcctgggtggccacctaccacgttcagattgttgtagaaagatttaaattctgaaagaaccgtatcttttctgacataccaatctgtcgtattcattttgtcatagtgggcatattctcctttaagatccgtgctttttcctcctgcagggttcaaagagttaaaactgataaatgtatctcctgaaaattgaacggggctaccgtcctcatatgtggctactagctgcacattcatttgtgttgaatggtaaataattcctgagaaaagattgtctgagatccaaagtactgttctttttttagatttactcattgcaccattcgtatttttatagccatcgtctcgaaaatgagtttttgtatagttgttatctagtagattccacggcaacgtatccgagtataagtgaatattagatagaactagcttgatattgacttttttcccgttatacgtaccgatttttccatagtcaatattgactttggtgttggttgttacgccttctaaaacaaggtttgtttcaccgtattctttttggaaagaaggatagcgtatttttttgtttccctccactaatcctacgtagtcgtctgtaaaaccacctttgttggcatcaacatgatatttgtaaacttttgacgctccgtttacagtaatatttgtttttgcattaggaacatcttttggaataataaaattattctttacgttctggattggatttgacggatcgacaataactttttcagcaaagacattggctgtttttaacccaaacaatgtacctaacatcatcattatgggaaaaacatattttaaccgtcttgtccacgagtgtttaaaattcatcccttcatcccctcttttttataaatgactagtgaaattccgacaataacgatcaaattgatcgtagtaaataatggattcctaatgagcttttccataatatctagcggcatggaagcagctggtatgtttaaaatcctcattaggtatagttggtagcttggcaaaatagatagtttagaaaataataaaccgcagtacaaaaagactgcggttaaacaagaaaaattgaataataataatttgatcagtttcattttatttcttccttaatctctagaaaacaagtgagtaacaaaatcccaacaattctcaaagaagtttttctttacgccagtagaaacgattttttttacttcttctttaggttgcgaagcttctgatttaggatagatccacacatcctttaagaattcaccgtttttatcagaaacaggtgttaatagcaaaatatcctcgctattagaaatgttttcaggacttgattcattgacaatataataagcttgtttctgatttgcctgtacttctaccgagaattcaaagacacctgtttgttgatcaattgtctttgtttctccattagaaactagcttcaattgatcactggatagttttttcactcgattttttaattgggattcaatttggtcagtagtgagatccttaacatccatcttttgtaaaatgtccgatacatcataaacagaaaacttcgcgccatttactccttcttgtttttcatgcccctggttgtctaattgttctgaagaaataatcttttgaacgtgaatggtctgtttgactatttgatcgtcttcagcaattttaggttcttctgaagaatcaactgttgacgaatcgacggtttcatcgctgctttgaatcgtgctgctatctgacgtttggattgtttgttctgtgctatccgtgctttcttgtctgtctgcaaacgtcaactgtgtgtaggcagtgaaagaaaaaagagcggctgcacaaacaaatagccattttctatttctcatgttggttaccctcctttattttttctttttataaacaaatagcgaaccaatgatcatgactgaaagaaaaacagtacttcctaaaagccatttccaagataatttttgtttcttattttcttcatcttttaattctgattttgtaaaggttactcgcttcccatacactagaaaacggtgtgtgttgatccccttaggcgtacatgtcattagcgttactcgatcttcattgggatttgattctaagtaagtgacaaagtttctttgtagttcgtctttttgcacttcctcaatccgatcgatttgataagcgtgctgctcaccatcaactttgatataaaacttttctcccttttttactgaaggtaaatcatcaaaaagattatctttataaagtccactatgacctgcgattaaaggatttttaccgtttcctcctgtaatatcaccagttccttccgtaatacctacaccattttctaaaattttgtcggacgttccgtcataaattggtagttttaaagaaatacttagaattgtaagaataccaacaggatcgcctaactcaatcttagcaacatccaaagaagaatccgtttctgctgccgttcctgttcgatcgattgcggcaatctgctgattttgttggtatttcgccacactcgcttcagcaggcatcaaaagtaagacacctacagctgaaagtaaccagaaagcaatgatccatttacccatgattcgctttttcttaggcttcctgataatcattggttttgatccttctaggctttcttcttaaagtaaacaactgcagaaagtgcccctgctcctagcaacaagcaagagattaatacatacgtttgaaaaccgttgctaccggtcattggtacggaagctttttgattgtttttgatcgtgattcggttttcttctttgtatgaatctttgtctactttgaaagagatctctttcgttaatttttgatagttttcaggcgcttttgtttcttccagtgaatattcaccttcagttaaaccagtgatttcaaagtgaccttctttatctgattttaggatcgctgcatttgctacatcgtctacccatactgcttctttgacaccgtctttatccgtatcaactaatccaccataatattttccttctgcgtttttagcagcaaattctgcgccttcaagcggtgttgctttgattcctgttccaaatagtccgctatcgacttttaagaattttgcaccataagtcacaacgtcagctttcgttttttcgtggtgttcttcctgattaaatggattgttgttataaacgaaatccacgctatttgttaatggattggcaacagctgcgctgtcatttacatacatgttataagtcatttgaagatcttgtccgtgtaaacttgctacagtatcacttacttggccattattcacgataaaatcgatcacaaagccattttctgaattttggattttataatctgtattttcttttaataccacagatccatctttatttgttactttgatatttgctttagcagcgacataagaaagtccttgttctgctgtatccccccatttaaatacactgtaaggagaagtttcgcttttcactccgtttactgtgataccgtctgctccgcctgcaatgtctgttgggatatgaatcgttccttgataatttactgcgtcaccaatttggaaagaatgttcttgtcctgttccatttgttactgttttatcgatcactggtgctttatagtttacgtatgaagcttttaagtcacttgtcacgccatcattcgtaatttcaaaggttaatttattgtgcgcatcgttgcgagcgtctgcgcctaataaatattgatcggctgttggttctttatctgatcccactacaacttctgaaggaacttccacaaaatagtattttcctaacgtcaaatcagtagcagtcagctttccttgatcatccgatacaagatctcctaattttgttccttttccaggttcgcccttgtataactcaaattttgccccttttaaaggtgtttgtttgctttgagctgtgccatcgtcaccaaatttcgttaattcaaaactcaacttagaaacaatatttttaggatataagtgaatgtcttttaaaaaacctgaacctgtattatcagtcattggcgcaatcacaaccattggttttgctttttgtgtgactaatccagcagcggatttactttcataaaccacatatacattccctttggaattgacataggctggttgatcagcaaaagtgatctcaccattttcatctacagctgaagtaattttgttggttgcattcttgacgtactcactgttagatcccttgtcttctacatctttaacgatttcgtccaccttcgcgttggttagatcagaatcttcagtcggtaatacttgatccgtaatatttcctaacgtaaactcaacatcaccataatctgccttgttgtatttcgttacacctgtaggatattgatcgtgcgtataaccatcgtttttgatcccgtcaatatcaacattcaattgcgttccttgatcgtacattaatttatgaaccgtgatattgaccttctctggtggcgttttttgcgtgacatcttctgcatatgctcgatatccctgaaagcagcctgcaatgattcctaacattccaataagcattccagctttttttacataccgatttattgccattttttactctcctcatttcatatttcaacgactcacgttgattaaaaccttgttattgtagttctccctgtaccacgtatctttcttttccttgtgacgtataaacacaagtaaacaacgttaataagggtttctctcctttctttggcaaagacaagaaagagttctcttcaggaacgccatcgattaatttaaagtactcaggtacgataaatttacgcgttaccttgtaacgatagacgccatcgttactaactaagtccatcacctcccctaatgacaacttttgaatatcagaaaataaaacacctggcatttccatgttatgacctgctaggacatagtttcctttgcccatttcagcatcttcataaaaataagtagccgctccaagactcaaagtgtattgatttgcccctttaaaaattggcaatgctaaaccaagtgcaggaatctgaatttgtgcaaatacttgtttattgacgcccatttcgattgcttcttgttgtatggacaacatttgccccaaagacatatcattattgacgttcgttgcatcctccttataactctttgcatgtgcattgatttgatctacgggcatctttttttctatattttgcttaaacacctctccttcatgtttttggtagctaacatagccaaacacactgcaaacgacgattaaagcgactcctaaaaaaccaaataaccattttctcatccagctaccccctttcagacaaaacaaaaaatctttttctcatttccatagaaaaagttttaaaaatgaattctattaatgaatgtcatgagacttctaacaatagttgacaattagaacttgttttcacataagttcgtctcaactgttcaaagtttttcattgaacctaacaaacaagctttctcttttcctgttatctgcatatcattgatatattgcatgacagataatcttttaaggtgtttttgtttcatcgtttttagcaacttttcttccatttatttcgacactttttttctgttttcgatttcttcataattcatgagttttcctaccttccttgttttttgcaaaaataaaaaagcctatgatcacatacgctctacacttcagtcttgggttatctttttctttcgtttaattactggccgtgctggtttcaaatccttgattccattatgggttctccaataatcgaattcttttcgtaatctttctttttccatatctgttcctttagacagggatttgaatacatctttaggtgaataaccacgagctaacagctgtacataccttccttttgtcaaagtatccatatccatcgcctctaaaactggtcgcgccatctaattttcctcctaaatgaattccttactcaatgcctaaggtaatactacctttttattattcgtcgtgacttcttctaagcctttatctgtaaaatttattcctccagtttttattcttctttatccgctacaaattcaatgatttcaacgctgacaatataatcactcaaatatgaccaagtatcttcaacagataattcgtctccattatcattcgtaagcgtcattttaaaccattcattaccttcatcatcttcaggtagcaagccgaatccaattggattatcagtcaatttttgatagtataaatcatcctcgtctaatgctaaaacatctaatcctttacaatttccgcctcttctaaacgtcacaaatcctttgtaatcccaacgttggaaagaaaccttaatagtatgtgtgcccaatcgtatattcggatcataatttttcatttgtcattcctccattacgtaaatttcattttctctatgttttatatcaattttttcactttattcaggactcgttcatattttatcgtttttcgtttacttaaaaatacataaaaaatatcgactcgtttatggcgtccgaaacgagaaaccctagtagaaatcggtaaatgctcgattgatccaatgaccaacgtcctcgcaagtatctacatgtactgcagcacacgacacaatttcttgtgcgtcctccccattacgagaagacctactccttattccatgagtttgcgtcaaagcctagatcccttagtagctgctcatgattaatctaggcgctattctaacttgtctaacttctaaattccctcttgtttactctgtgcatattatttacacaaattcatttcaccactatccaaacaagggcatttactcgattgaccaattttttacgttaccaatcgtaaaaacctaccccgtcaccccccgaaaggaattgttgatagatcaagtctactccttatttttctagtaattctaagttcttttagaagtctcgacaatattttcaagcaagcgaaaaacgataaaatacaagttatgagaatgatcaattcagctgattaaacgccccatcccttttgcggtacaacgcaagactccattttttcttcgaccaatcagtacaccgttttggtcataaacatgtttgattgttggatatagttcttttaaagggataggatcttttaaaattatttgcttttgtttaccagcgtaataaatcatttcctctgagactttgtctttctggattatatatttcttacactgcacaacggttttactttggccagttgatagtttcttcgtgattttctctgtagcggtacaccgtttaccgtagtgacaaatatcttcgagactcaaaattcctgtatatgacataaaataatccacccacttactttaaatatttttaataagtttttcttgttatttttcaaaaatagagaattgattttcgttcatgacaaacaaaaaagagggaacgcatccaaacatgcgttccctctaatttcagcgttcgtcatacggcaaagagccacacggacatttttataacattatgcttaggcatagattcatcgtaatatcacgtatttttaaccttaacacagccaaaaaaagtggtatcacttttgaatatctgttatactaaatccgttgcgggtaataccgtaacactgaaaggtaaacgcattaagggattaaaggttgtcttaatgccacctgtggacgtcgacgaaggttaccagccttccgagtctcacagggcctttcttttttttgtattttcaattgtccaaatttatcgtccaaaagtgcagaacgaaaattaattcatcacaagcgtagcagacaactaaatttatacaaaaaaatgtaagcgaataatattcgtattgcctgaaaagaagtaatatcaaggtttttagcttttttaaaaaatgaaattacctctcttcgcgtattattataactaaaaaacagcaacatgcaaacgtttgttctcttttttgtgttggaaattaattattaactattaacaattatgacgtaaaaagctacgtttgtgatttttatcataatattttaactcataaattctattaaaatagctatttctttgtaacatttgtaatataattagaataataaaaaatttttaattttaatgctactccatgaagcaacaatcaatttgtcagtgaaatttcactctaaccagtctttcgtaatagtttttgggaagctttcagaattcaaacgtttttcacttgatactttagcagctattggtttttcgataaaccaattttttacatagacaaaaatcaggttctggatattttcaactttttcggtttttaatttttgataggcttttaacagtgtcgtgtataattcttgttctgcattgacataataactatcgagttcttcaaaaattattgaaataccactttctgtttcggcttttttctttgcattatgaatagtctggacagttttttgagcttcactgtaacttgaagaaaatgtttttattaaatttaatactcgttcagggataaacgtagcaatgctgtcgtttgtcataattgtctcaaaattgtctaacaacaattgatcttgtaggcggtctttttcagtgtctatattgtgtctattagtgtctaatatattattattaagttctggtatgattttcataccctctgatttatcaacgttttggcacggtatgattttcataccctcttgagccccaagggattcagcgtctgatttttcgtcgagggtgggtatgattttcataccctctgatttatcaacgttttccctattctctctatcaaatttttcgagtaagtagatatcattttctgagacttttaattctgctagatatagtctattaggattatttttccctaactgtttgttaaatcccatctgcttttgtaataataaaccaaaggattccaactcttttttgattgctatcgctttttgtttttggcagtttaatacgctacatagttcatttgtcgtataagtaaaataaacattaccttcttcatcgatttgccgtttgctgattgcgatctctaatcttgcttttaaaagcatataggcaatcttagttgaatctttcatttttttgtattcgtcagaaacaataaagacttttggaaattgataaaataattcgttgtaaactctatccgccttaaaaaaattaaaatcagtcattgtagatcctctactttcacgttgttttatttatgtaaaattacctactcttttcgaaaatagcaaagataaataaaaaatgcaaacgcattaaaactgttttttaattaaatactacctaaaatcagaaataaaatgaattatgtactacctttaaagtcattaagaactactttaaataaatattatttataattaaatactaccagaagaacgtatgaataaaatttagttttaaaattaaagataattaagtactaccagtgtcaaaacaaaaaataaattaagaactaccttatgcatataaaacatactaccattactagtaatatatactaccttatttcagtagcatatattatattcttcttataagacaaggctttaggctagaaaacaatagattatatactactaaaaaatacaataagtactaccaatgtcagatatatataataattatgtactaccattaaaattaacttatttaataagatactactgtgttaatctgaaaaaaattactttaaagtagttacatactacctgttaaattagatactaccattaatacttaaattagatactacctatatttatattaagtactaccgttctaggaataagataataaaaaaaaactaccaaattgcaattaaatactacttaaaatgtaaaaaataagaactacccaaattaggtagttcttaataagagaatatcagataaatttgtacaagtcataaaaaaattaatcttaaatttttaaatatatatacctgttaattataaactactttatttaggtagtacataattaacagataaaactacatgcttgtagtttgtctagctaatgagttgcatatgatttatataaaggtgtgcagcataacttagttgaagttaagagaatagaataaatattttttgttttgctaataattaaacactacctaaatatggtagtgtttaattatataatattcattttgttacaaataatcgtattataaaagcataacaattgggataactattttttagattatttaagtactacttaaattaggtagtacttaaattttggtttaaggtagtaggtaattaagaaataatatatatcttcttttataatagaaggggagaggcctagttaaaagcagcgacaattaataacaatgtatttaatgcttcacaaaatccatttggtggacaatgcattgttattagcgatgatctaccgttctaagtagttttttctattggttgcattcgtgactaattatggtataattatgagtaacaaagaggtatttcattatatcatcaaaccccatcagcgtgtaggctgatggggttttttttacgtttctatattatagaattaactggtaggcttactgtcttttttggcaattttgcaatcaagccacttgcagatgtagtgtgcagttacctctgcaaatggcttgattgcaaaaacaaaatcaaaaaggtatttcattatatctcctcctccccttgccagattaggccggggtagcagacagcaaaactattataacataactgaaatacctaaatgacatatacagatatgataatttatgtattgatttttcgggagcgtcaataattttgtgtaaataaattgtcctcctgcaaaataattagttactcagtaaacattgaaactaatgtatcggttacctgttgaaaacctttatggcttctgtttagaaatttttgattgtatgtatcaaaaatgctgactagaaagcgttctagtgattcttcattttgaaactgctcttttctacggctgtatcttttaatttgcttattgaaagactcgattagattggttgagtaaatggttctacgaatgctaggtggaaaatcataaaaagttaataagtcttggttttctatgagtgactgcgtcactttaggatagtttttcttccatttctcaatcatgccggataagaaggtattcgcttcttcttttgagttagcttgataaacagccttaaagtcatcacagatttcttttcggtctttgacacgtactttatgagcgatattacgagatacatggatacaacaatgctgatattttgctttaggataaatttgatggatagtatctttcatgccttttaagccgtccgtaataaaaagcaagacttcttgaactcctctggagttaatatcctgtagcagctcattccaaacgtatgttgattcagttggagcaatcgcataactcagtacttctttagtgccgtcttctcgtataccaatggcaatataaatcgcttctttggatacagtttgacgttttagtggaatgtaagtagcgtccataaaaatagcgacatacttatcatttaaggctctggatttaaaggcatttacttcttcagtcagaactttagtcatgttggacatggtttgtggagtatagtgatgaccgtacattttttcgatcaaatcagcaatttcagacatcgtaacacctttttcgaataaatggataatagtggtttccaatgtatcgtttgttcttttgtaggctggtaaagtttgttgtttaaactcaccattacgatctctaggtatttccaatgttaattcaccatattcggttttgattgatcgaaagtaagaaccgtttctcgaattacctgaattaaaaccagtgcgatcatatttttcgtaatctaaaaaagccgttaattcagtccgtaggagtgtgtttatcgctttttctaagtgcgaacggaataattcatttaaatcgcctttagtgactagagtttgcacaatttctgtagtaaaatcattcatagggaagtcctcttttctgtgaattggttgtcgttaactttattctacagaagggacttccttttttgtatggattttttcatttacacaaaatattttatactctcgatttttctaacaaaagcacatattttaatatatactacctattttaggtagtatatatttttagatacaatatcgatcagttttgaggaaatgaaattctagatattttttgctacatagagttactttcaatattttttaacgtaattaggcagaagtcactcatcctctataggtttgtgatgaaattgctattgatccatttaagtaagagcaaaaaactggaggtttatcaggtaattggtctaatggatttaagtatgcggtcaccgtgtatagagttgcttatgagattcaagaaaataaagttattccagtattgctatatggaacacataacaatttttatgaattagccgagaacactcgcaactttattcgtgtagatgaatcggcttcggttgagttataactttagctatatcaatcaaccgaccgacatatgttaaatctatatataataaaaatacctacttaaatggatgttaacggaagtgtatggtgagtagttcactcgtattttgatatcgtttgtatatgttttcagcgttctaagtggcttattttgtccaataataatatggagtggaatcccttaagaaacaccgttggcaattgtcgttataacatgttataatttatttatcaaaaactaaaagaagtgtgataacatgggaaaagaactaaaggttagaaagatcggcaatagcgtgggagtgatccttccaagctctcttggattaaaaagcggagacactatccaagccaaacaagaaggcaacttattcatattagatactactcaaatagcaaaagaacacgatcgcaaattgattgaagaaagtttccaagattttgagaaaggtttaacagtttcagaaattgaaatggtaaaagctttcggaaaatacggctggagtgaatagatgaaagagtacacgctagtttattctaaaagtttccagaccagccttgaaacgataatagaagaatgggaaaatgagcttgctctttctccagccagcataaaaagatttgtaggtgcgatccagaaggctttagaactaacaaaaaattttccaactatgcatgaggaagtttccgaaatctatggaatggatatcccaacatatcggatcgtgatcggcaaaagctatgccttattttatcggatcgaccatgaaaaaaaagagatacttgtaggacgtattttccaatctaaacaaatgaaactaggcttttaacaataattaggcaaaagtcgctcatcctctacaggtgggtgattaataccgctcgatatggttgttaaccgtcggttactcgaagattgatatataagacttagtacctttttattttgctccatgttatggccgaaggtctaaagatacaatcattagtctagagaaaaattaagaaccgtaggaactacggggatcgcttggtgaataagagacactgctattagtgaaaaaataagatatcaagtacgctctattcccaaaaatttcgtgactttactcatgagaggttcaagtagtatatttttaatcaaaattgacgtaacttttaataaatactacctaaataaggtagtatttatttttgtgttttaaaagaggaagtccaatatatctatgggaaacttcttaaatattatgttggtacatgaaaatatacatccctgctagactatttacaacattttactttgtacgtattcttgttttaaaaggaatgggataaaatataggtacaataactatttgatgctaaatataattaatggaggagagatagtgaacatacttaatgaaaaaagatatgtatggtttgctggtaaaaaatatattactactttcaaaagattatccgagttaatgcagcagactgttaaaagtgctatgcctgaaggatacaagtttaattttgttcaatcttcagtatctactgaaagtatctatttttcaattctttctgagagtaggctttttcattttagaataagttctcatgtaaagaaaactgatgttgatatatatacgttccgtacaaataattataaaaatttaaatgatttgagtagaagtatcagtgaatatctcaaggggaatagctatctcaagattcgattttcacatatattaattttactaccatatttgaatgagaatttcaccctaattcaagtagataagtctttcattgcctcaggtaatcaaggaaatatgaatattaaaagtaacaaaacgtcacgtgtgctattggcgttgatgggttacggaattctttatagagatgaccaaaatggccagattctaataactcgggccgggcgttcattattaatgaaatatagaaaatttataccggaagattttcaaaacttacagttagaaaacatgtgtttagaagatttatttagattagcagaagatgataagtatagatttgaagttttgaaaattcaaaagaatgaactattgaataagttatatcctgagaatgcgataaaagcacattttggtgatgctaatcatatgtatagttggttcattcctaaaagatttagagggaaaatcaatgctggagatcaagtgaaagtactcaatcgaaatagtacagatgtcgtaatgataacagatatctatgtagaagatgaagatataatcaaatatatgaagcctgtgataaaacttgttaataaaaataaaggaaacggataacactttacaatgctgttttggtactccaatttatttaaacaaaacaatcgaatttacgtacttaattaagtacgttagaatggagatataaattagagggggagtagatatggcaaaaacagtcttaaatcctagctcagcacggaaaaatttttataagttgttgaaagatgtaaatgagaatcatacggaaattgaaatcattagtgagcgcagtgaaaataatgcggtgcttattggtttggatgattggaaagcaatcaaagaaacgctattacttgagcaaataggcactttgggtgttgttcgtaagcgagaaaaagatgatagtggatttactaatgttgatgaaattgattgggataacttataatgaataactattctgtgatgattaaaaactcggctaaagctgatttaaagaaaatcaaacagtctaatttgaaacctcaatttgagaaggttattcagactttaaaggaagatccctatctccctacccaatcatttgagaagttaaaacctacatatgaaggtaggtattctagaagattgaatagacaacaccgggttgtttataaggtagatgaagatgaacacgtggttgaaatttattcagcaaggacgcattacgagtcacagtaattacttgtaaatacattatctcgtggtataatgtatttactaagtaattacatactgttagaaatgagggatttaaatgattacaaaaacaagaaaacaaggcaattcaatcatgttgacagtacctaaagattttaatgttcctaatggagtcgaagttgaagcaaagttggtagagaatggtattctttatgaatttgttgaaccacaaaaagaattttatgattttagcgaagatattttgtctggttctgttgcgaagtttgaaaatcaaacgcgccctctctgaactccaaatatcttaggctgttattcccattaataccttgatttcagtagacaccgaaaagccgaagagcgttccatttcttcggttctttttatatattcctcgaatggtctccatgcccttaatcgtggaagaggctgtacggagactttgataaaatttatttcgtcgtttaataggtcgatggtcttgttctattaaattgttaagatacttcacagttcggtgctctgtcttagtatataaacccacactctgtaactttctaaaggcggagccaagagaaggtgctttatcggtcacaattgctttcggctcaccaaactgtttatggagtcgttttaagaaatcataggctgcttgcgtatcccgtttctttcgtaaccagatatctaaggttaagccgtccgcatcaattgcacgataaagataatgccaacgtcccttaattttgatataggtttcgtccattttccatgaatagaaggattgtctatttttcttcttccaaagataatagaggactttgctgtactcttgtacccaacgataaatcgtagtatgacaaacatttattccacgatcatataacaattcctgaacttcacgatagcttagattgtaacgcaggtagtaaccaacagcgacaataatgacgtcttttttgaattgtttgcctttaaaatgattcattactctgtcctctctatcttttttctcaattttacactaaaatagattttttggaaaactttgcaacagaacctagttttttaatttattatgataaagatcaaaaattatatttagtagatagttgggttccttttaaaaataaaatgaatgatatgcaatataaatggggagtatctttagataaaaatgaaataaaaaggtttaaatatgattcagactttaataattataaagattctggagattatgaagttgtctataaatcaggaaaatttgcagattagaaaagagcctttaacagctatttgtcagttgttaaaggttcttttttagtctttgctttttgtttagtttattatttctttgtgcccaacagggtatatcctgttggtctattagtatgtcatttttctagataaatggcataaattttcagcgctaagtgacaaaagcaactaatttttcatgatagatttttaaatatctcaatctatctccaaaattagttgcttttgtagctatagttgactatgaatatgacaaataattagaaaaaactgtgccaattaaatataaaaatgacactattagtatcttgttgaatacatgagaataagtggtgtgttttgcaagacttttgtacatataattgcagagaaaaaatgcacaatgctgcaacctgatattttcctttgattaatttgattttgataaagcatttttcaatcgaaagctctcacccgtgaagctgagaatatgcgcatgatgaatcaagcgatccaccaacgcggcagttaaccgtgcatcaacgaagactttattccatttgctaaactctaaattactagtcactataacgctttttgtttcataccaatcgctgatcaattggaaaagcagttccgcgccttctttagtgaaaggcacataacccatctcatcaagaatgattaattttactttatcgaagcgatgcttgaagacctctaaggtattgtttttccaatggtgttccaattcgttgactaaatctgatacccgccaaaagcgtgtatcgatacctgatttggctgccagctgacccaatccacaagctagatgtgttttaccggtaccgggtgtacccacaaatacagcattttctttctgatgaataaacgatagactcaataattcatctttagtcgtcgcatttggcaaacatatatgatcatgccattcgtaatcctctaaggtacgtttatttgggaactttgcttgttttaggagtcgggcagttttcaattcttcacggcaagccaactccttttccagaagatacatcaaccaatcttctttggtttcaaagctgtaatctaagtctttgcgaaccaaagtgggaagaacatgggaaagtctcagcaacttacaggcagtttctaaactttttgcttgatccactagtcaatgacctcccctgttagagacaagaaagcatcgtattggtgccaatcaatatcatacgcatcggtagtagtcgaggcactaaacatgtcgtaaaaatgtgtatcaatccctaacatatcatgtgtcaccaataaacctgagatttgatttaaacgcttctcctgttctttccaatctggatgactgagaaataacttgattcgttcgggcaaatacttccaatagcgagagtaatgcatggcacgcggttttctgcgccaatcaggaagaattgcttgccaatcgattgctcgttttttcatcatataaggacgaagtccttctgaaataatctcaccatcagtgctgattagctgataggaatcaaaacgaagcagcccataaataattgaataattgcgtacacgtggaacgtggatccgttcgttatctaatttaatttcgttgtacttattggctttgacttcgatttctttaaatactgggtaatcggtgtccggcaaagctagcaaatctgttttttctgtgttccatagatcattgataatgacatgtttttcgtaatggattcgctctcgatcgtgtgacagctccaccgctaatgcctcgttgaaactggcgaaatccttcataatcggtgtagatgaaaagaagttgtaccgtacatagccgactttgttttccatactacctttctcgtttccgctacgtggattgcacacctgtgtctcaaaaccatagtgcatagaaaatcggaggaaaccgtcagtcagcaccgcttgttcagtctttgtttttgtctgagtaacggccgttgacatattatcaatccgtattttccgaggaacgccacctgattggctgaagagttctttcatgccttccaacaaacattcttgattctcggcggggagtacaacggcgaatcctgcattactaaaagggaaagtcatcactaataccttcacatctttaaacgctccatcgtgacaaacttccatcgtaccaaaatcaagttgcgcttctgctggcgggtgttcaagacgctcaaagccttggtcttccagtgtttccaagtagtgtgtcgctttccaatcttgaatgaatacacagactgttcggtaggatcctggaaagccatcggcttttaaagcagtagtcattgcttcagcagtcctacgctttttatttggcagcttagcatcttctgaaagccatagggaaacgatgcctccccacttttttgtatacatcataccagtctttttgcgtgctttaggttgcggcagcaaatcatcatctgcatattttttagccgtgcgccaatttacatctagctcctttgcaatatgattaatggatttatcatgattatttcgtaaatttctgatagtattaatatcggtcattgtgagcatacctttcttacctccagttacagtgtcgagactataactttagaggaatttcaggttgcccgcaatggctttttatcttaacttaatcgatttgcggagttgtgtagtttttcgttgcacttgtatgtacttttattctgccataaacagcttaatgaatgtccacttgaaaaagtgaataaacgaaatagatgactcgatttaataaggaagtaaacccacacagaaatataggtgattttccttgaatgaccaagatattgaaagttagtgaaaaaacacaaaaaggtagccctattcacagaaggtctgccttttgtgttatcgccagcaaacattagagggggtatttcatatagcttttgtcctctcgacagtcctatcagtttctcttttaacttatctctaagtgctgtccagttttaatagcttctagcttgtttcctaactgtgtttttaatatgttgaaggcttttgaacctgtgcagtggcaagtaaggattttttctactcgtgagtcattcaatttatttccaattttcattacctcttgctcaggtagacctaaattatttatataaggtatgccaatcatatggaagccaccgattaggtattttatgggtttagtcggaaatgtttcaagagcaatttccatcatatcgataatgccatgatgactacagccagtaaagacaatcagaccgtcttcttgctcaattacgaccaataattcatctgaaaaatcatcataaacaaatttatcatccatctttttgtataaattcttggtggtcgagtttgctttgcctagggggatgatatggaagctcggagcaagttctgttttcgtttttattgtatgtaaattctcatgcattttaaggatttcatttttaggaataccaacatacagaaacgtggttaaaatctttaaataatggggtaaagttacaccttcagctgtataaataggggcgtttcctgattttaaatatcttaacccgccggtgtggtcagaatgaccgtgtgaaataatcactgcctccagatcattcaaagtttcccccattttagtcgcattatagactaattttttattagcgccagcatcgaagagatatttcttccctgagtagttaattaagagagataacccatgtccacttttaaagttcaaatttattcttgagttttcaaataaaaccttgatttccactataacatctcctttcacatgaacgtgtattcatatgttgtagcacattaagttctattttttgttgtaattaccgaaaaaaatattaatggacgctttttacgctttatttcgtatgtggaagaaaatttcttaggatgtggcgggggattggggcaaagctaaattccaattacagtgatcatttaattagacacctttaaatacccacactttcatcaacactataatttagggaaagaaaagtgttggcatgatatagaaaaacctttaattaacagcgtttcctaaaattggcacgcatcttgcttatagaaaagcgtaaggataggaggaatgaaaatggcaactataattcttgccagccatggggaatttgctcaaggattaaagcaaacagcgacaatgattattggagatagtgtaccaattcatgccttgtcagcatttagagatgaagatgaatctattttggtacaaataaaaaaacttttagccacaatagatatagaagaaacctacattttaactgatattctaggtggtagtgtgaataatgatatgctcactattattaaagagtatgagggattgcaattaattactggaatgaacttacctttagttatttctattgcaacctataatggaaaaattggggaaagtgagctagaaaagcttattaaagagagtcaacaatcagtgattgattgtagaaaattattagtagaacaacttactggaggagatgacctatgattaagttagtacgtattgaccatcgtttgttgcacggacaggtagtattttcttggagtaaatcattaaatatcaatcgtattattattgccaataaagaggcagcgaatgatgaattcaaaaaaatgtctttgaatttatctaaaccgactggcattaaattaacaattttttcagttgaacagttactagaaaaaatgcctaaaatcgaaacacttaacgaaaatatcatgcttatttttggtaatacaaaagaaattcgtcaattttgtgaagcctatcctaaagtacaagaaatcaactatggagggataatcaaaaaagaaggttccaagcaatttagtaatgccattttcttgaatgaatctgagcaagaagatgccaaaaaattaaaagctcttggcattaaacaatttattcaacaggtaccaacttctaaaaaagaagatttgaatacaatgttataaaggaggaatgaaaatgctcgttcagtcaattggtttagggttaatcggtgttttttgtattttagactcaaggcttttaggaagaatgaattttgaacgaccgttgattgtcagtacgcttgttggtttggtacttggagacatggaaaaaggattaattgttggagcctctttggaattgatgtccttaggattagtaaatatcggagctgctgcaccacctgatatgaatatggcatcaattattgctacagcctttgccattttatcaaatgcgaatgcagaagcagcattaacgattgccattccaatttcagtgttaggtcaaatactaggtatcttaatgcggacgattttgtcaaatttgactcacgttgcggatcgctttatcgaacaagggaaatttagccaagcaaggagaattcatatactttatggctcgggattatatgctctcatgtattttattcctatttttctagcaatttattttggaacgaatcttgtttctcagattgttgatgcgattcctgagtggctaacaaatggcttaacggttgcaagtaaaattttaccagcatatgggtttgcgttgttattacaaacgatgttaacgaaaaaaatggtgccatttttattacttggatttttaattactgcttattctggattgggaatcattggtattgcagccttcgcatgtattgttgcgtttgtcatggttcaagttcaaggtaaaaactcaaatggtaaccaaaatgagccagatccattagatgacttataaggaggtagattaagtgaaagagaaagatcaaaatgcatggaaatatcggcagttcttatggcgttcatgggcaattcaagcctcatggaactatgaacgacaaatgaacatgggttttatgtacggaattgcaccaattctagataacatttacaagaatccagaagatgaagcaatgaagaaagaagcttacgagcggcatatgatgtactacaactgtacccctcaaacaagtgcatttgtgttagggttaactgcttctatggaggagcaatactacgaagaccaagaaaactttaatccggaatcaatcagtgcagtgaagacttctctgatgggaccgctatctggtgttggtgattctttctttcaaggaacgattcgggtattagcctttggactaggaattaatttagcccaacaaggtagtattttaggtccaattctagcaatgttaatttcctttgtaccttcctttttagttacttactatggtgggaaaattggctataacatggggaataaatacttgtctaaactgtatcaagaaggtttgatggataaagtaatgtatgtttgctccattgtggggttgatggtcattggttcgatgattgccagcatgatcgggattacaacaccaattcaaatgggtaaagcttttgtcttacaagatgtattagatagtattatgccacaatttttaccattaggattaaccttcttcatgtactggttattgcagaaaaaggtcaaaacaggatggatgttggcaatctgtttagtcggaggaattatttttagtttgttaggtatcttacaataagggaataaccaataaatttggttgaataatataaataaggaggaattcaattgatgaattcaaaagaaattgttaaagaaatcgtagcgaaaaaagaggtaaaatcaatcgtatttgttggctgtggcgcttcaaaagcggacctttatcctgcaaagtattttctagaccaaaatgcgaagcagttacggattagtcattacacagccagcgaatttaactatgcaacaccagcatctgtagatgagtcaactgtcgttatttcagcttctttaggaggtacgactccagaaacagttgaagctaacgcagtagctaaagaaaaaggtgctacagttattagtctaacacgaagcattgactcaccgttaacaaaagatgcagattatgtaatttatcatcgatttgcagagaactatgctgctaaattagaaaaaacaggctactgtttagaattggcagtagaacttttacatcaagtagaaggttatgaccattatgaagcaatgcaagaaggatttgctactatctatgatcttgcccaaaaaagtgcagaatcagctcgtaaagatgcgaagaaatttgctgaacgctttaaagatgaaaaagttatttatgtaatgagtagtggtgctacacatgaagtagcatactcaacatcaatttgcttgatgatggaaatgcaatggattaattctggtaccttccattcaggagaatttttccacggaccattcgaaattgtggataaagacgtaccgtttatattattaatgaatgatggaaaaactagaaatatagatgctcgagcattaactttccttgaacgctttgatacgaaaacagaagttgtagatgccttggattatggcttgtcttcacatattgctaaagaagtcttagactactttaacccattcgtgattactgcagtatttagagtttatgcagaagaattgtcagaagcaagagaacatccattaactaagagacgttatatgtggaaactaacttattaaaaaatagatcaaactaaataaggtggcttgagaaattaagccaccttgttttcttcaatgtgattttatacatatggtaaaataactagtacatatggtaaaataactagtacatattgtgaaagcaggtggcaagatgcagcgattaaatgactatctttatcaactaacattgcttttgaaatctacgccttcagataattattcagctcgcagtatttcgcaagctttacagttgaatagaagtacaatcagtagctacttaaatgaaggtgttcgtgaagggcttttcataaaagtaaaaagttacccggttttatttttacatagaacagctcttgaagaactacatatcacactgaataactccgaaatagaatcaattgaaagcttgttaacaatttctcaaaaacccgcattagatcaagtaattggctctaaaggaagtttgaaagaagcaattgatcaaattaaaacggcagtcttatatcctggaaaagggttgcctttattattgatcggcgctagtggatcagggaaaacctttctagcgaataaaatatatgaatatgcagtagaagaaaaggtcattcacacatcggcacctttcatagattataattgtgcacaatatgtgagcaatccagagttactatcctctgctttatttggctacacgaaaggagcatttaccggagcaagccaggagcatactggtttgctagaaaaagccgatggaggagtattgtttttagatgaagtgcatcgcttatctgaagaagggcaagagaaattatttacatttatggatacgggtgaattctctcctatgggggataatagtattcggaaaaaagccgatgttcgattagtctttgcaacaacagaaaatatatatacgactttcttaccaacttttcttaggagattgccagttattgttaatctacctagatttcaacaacgtccgtcgtttgaacgtctgtcattgattgatgaattttttgtttctgagagtaaaattttagctaaggaactatctgtttctgatgcattgattcatttcttaatgaatagtgattttgaaggtaacgtggggaatattaaaaatattatcaagtatgcttgcggaaacgcatatatccaccagaagagtcagcaaacaattcaagttaaattattggatatgcctttagagtacagttataaattcaaggagcaactaaataaacccagaaagaaaagagcagatcgaatctactatccagaagaaacacgacaagtgcaactagaaagaaacaatcagctttttgttcaattttttgaccaattacttactggattctctgaagtgattgaaaataacaaggatattaaactatttttagaagaaatggttaccaaggtaacacaagtaatggatacgcttatttttcaagaggattacgaaaaagagcagtctttatacgccattctaaactatcatattcgtcaaagtattgattttatgcgagaaagctacgggtttgaacaagatggtaaccgggtagtcgctttggccaactatctatatgtcaaggataatcaagtgatttttgaaaatagtcttcaagaaaagaaaaccaaagatcagcttaacgaattttttgctaatgttcttgaaaccccttattggtatgcaaaaaaaatcttaagccttttatctgagtgtttagatcaacctgtgtatgaagaggacattttctttattacgctatatttttatagtttgaatgtcacgaatgttaaaacaggtattaagagtattgtgctagctcatggttattctacagctagtagtatggcgaatgttgccaaccgtatgctgaataagaacgtttttcaagcttatgatatgcctttagatattacattagagaaaattgaagcaaaattgattcaattccttggagattatcgaacagattcaggcttgattttattggtagatatgggttcactaaaccaactaggcggtttattagtgaatcatctaaatggaccactgttaatcattgatcatatcaatacaccgttattattggaagtcggccaacaagtattaaacaataaaagtatcaccgaaataggagcagaaattgaaacaagtcttactttcaaaaagcagttactacttcccaagaaaaagaaaaagaaagccatcattacttgttgttatacagggattggtagtgcgacccagattcaggagattttaacgaaatgcttgaaagatgcagttagagaattagtaattattccgtatgattacaaaaagctgttagaaaacaagaattttgagactccttttcaattatacgatgtcatcatgattgtaggtacagaagatcccaaaattaatcagattccatatattggattagatcgcctgattaatggggaagcaattggcgaatttgttcattacttggaaaaagagctgactattgaagtgaacgatttacaaaaagaattaattttcaatttttcaattagtaaaattgtcgaaaatttaaccattttggatccagataaggtgctatcttttgtacaaaaagcaattaaagaattatcgaagttattaaattttgatttttctaataatcagctgtttttgttgtaccttcactgtagttgtatgattgaacgaattgtacgtaaagaaagtgtggatgagcaagaggacattgaagaatatatgcaagcaaatggagaaataatggataaaattcatagcgctttttttgagattgaaagggaatacacaattgaaataccagatttagagttgcgattattgagcgatattgttcaaggataggagtgaattcgaatgacaatgggagtaatttttgatatggatggggtactcatagacagcgagacattttattttgagagaagaatgaacttctttcaagaactggagatagatccaggatcaaaccagattgatgattatgtggggaaaacagaagctgcaatatgggaaacattagttcctgaggacaaatcattaagagaggaactttatccgaaatatgtagattatcgaaaaacgcatccaattgatttcgctaaagatttacgaaaagaagtgaaaccgttacttgacttcctcaagaagcgggatataccattggcactggcatcttcttctccagttgttgagatagagagtatgctcattcaatgtgaacttactgaatatttttcctttgttataagtggtgagtcattaaaacaaagcaaaccacatcccgaaatatatttaaaagcgaaacagcaattagactgtgacttctttattgcagtagaggattcaacgattggtattaaatcagcaaaggcagcaaatatctatacggtggcattaaaacaaccaatgcaaatcgatcagagtgaagcagacatacaaattgaaagtctacaagaactggaacaaattgttttagaaaaaggttagtgaattaatggaaataaggctatatatctgtgctagctattttgactaaccaaaaaaacttgctataattcaggtgtagtaaaaggtgctggtaacaccttttacgaaaatgcttcggcagtgataatgggattggctttttaagttttttattttgttcgcaatccctaaggtcatgtgaatgatcctagggattgctagaatattttgcaacattctatctatttcagaacgtaaccttccccagttcattgggattcattagcatacaaccaacatttcaaaaagaaattgcactacaccattattagctattttgactaaccccaaaaaacttgctataattcaggtgtaggtaaaaggtgctggtatcaccttttacgaaactgcttcggcagtggtaatgagtgtggcttaaaggactagtcctttaagctttttactttgttcgcaatctctaagatcaagttaatgatcgataagattgctagaatattttgcaacattctatttcagaacgtaacctttcccattccactgtgattcattggcaaccctcctcacaaccaacgtttcaaaagaaattgtaaagttgttggggtaccacgaccgaacaatactacacctgaatgatagtaagttgtctcattaagtatagcatatcctctttttgggtaaatagaaatcgggtaagcgccccatagaacagtacctgtacgtcaaataacccgacctatagaatagaatcgggaatgtttggcgtttttagttacgagaaaaatgttgttgtacatccttgttccaaggcaacagttgatctaaagtttctgctgaaagtacgggaagatttggtatcttatcaaatagaaactctagatactttacaggattcaatccgttaagttctgctgttttatatacactcagaatgattcctgaagttcgtgctccttcaagacttgtggaatgcaaccaatttttccgtcctatcaccagctctttgatatttcgctccgcacgattatttgtgagttctaaacgaccatcttcaaaaataggttcaaaaccacttcgtagtttacacgcatattgaacggctgcatccaacttggattttgcaacaggatctatcgttgccatccactcataaaaagcaataaataatggacgcagttcttgttgccgacagcttaatcgcttctcaggagaaaagtctttccatttcttttctaggacaaaccatttatccaattgtttgactgcttgagctgcgggaatatccgtgtttttctttccttttggaattgcttcgaaaaatttccgccgaacatgcgcgaaacaatagacaagtcgtacactttccacggcattatacccgctatagccgtcacagtgtaaataccctgtaaactccttgagaaaagttttcggaacatctccagcacgactttcgtcgtggtgataataaacgatgggatgctgactgtcttttcctgtacaaaactgccagtaataggtatctgttttggcactttcaatcacacgataacttgtttcatccccgtgtagaatctcttcttgattaagatagactcttaatcgttctcctaaagggtctaacgcgttttgcactgctttaatatgccaattggtgatattatctctcgaaatatccaacccatgtgtttgtttccaatagttctcttgccgataggcaggaactttctgaccaaatttcatccggatcgtttccgccactaaactattggaacctaagctattagaaatcaaaggtttaggaacgatcgcttttttaaaagaagaaagtccttctttttcgcagcttttacaacaataggtatgttgataatgggtgagacaatccaacatagcctgatggaaacgaatttcttctcgtacttttgtccgtccgatatctttcatctgtgaaccgcaatgttcacaaaattgttcttccaaaggaaggagatgttctttctctgttataggtaagtgtttgattttgtctgctttcgttcctacaactcgttgatgtccttttactggaataatggtggcagctgcttctggaacacttacagaaatttcttcatcactaaaaagattcaattgcccattcgtttcctcaaagagagtctctttagagcgtccaaataatttgttggttaaataattgaccttttcattcaatagttggatttcagttgtaagattctgaatggtttgttgttgtgcttgattggttttatgggcttcttgaagcaactgaagcaacgtatctgtagtttccaaaatttttcaccaccttgaatcgaactgattttgttacagaataccacaagaaacgcacaagaaataggggttcaacacattttttgtgttaaccccccagcttaaaaaactcctttttttcctggcaaaatagctcgaggttgatcgatacttaatccttctaacaaccatcgaacctgttggttcgttaaggttcgaacttcgtctttcgtccgaggccattttaacttgccgttttctatccgcttataacagagaagaaaaccatcaccgtcccaatagagaagtttgaaacggtcttgacggttcccgcaaaataaaaaaacggcatcttcgtaaagctcgagttgatactcttgttgaataagactggcaagaccatcaattccttttcgcaaatctgtttttccgcacacaatataaatatgtttggtttgaagtaaatcataaagcattggacaacagttctttcaaaatagcttgaagaatataattgttaataccgttatagatcaaaacttcagaaccattctctcttttgatgcgcatcgctaacttggcagccgcgggtttacctttttctggtgcactcttttcgtttcctaattggacaggaacaatctcatttaatttatacatagaaaacctccagacttcttgatagctcaagtatatcttgaggtgcatttgttagtaaggtactgttctatggggcgcttacgaaatcggttacattttttatccaagaccaagttttttcatttggtcttatttgctatacccaaacaattccgcagtatagtcgacggtattgattttatcaggtgagtaatagaaacttgttttccttccccaaaacattacctataaaggagaaaaaatggtatcgtaattatataggtataggatgaaatttttttctaagaggagggttgttgatgaaaaatttacagttaaaatttattgttgatccatcgattgtacgctggtttcggattatcaatcaatttgagcgcaatcaacttgccacaaaaggagaattagcaaagagtaatcatgtatctgaacgaaccattcaaacagatgtcaataaaatgaaggactacttttctgaaagtgttcaatttgtttcaacgaaaagtgggtattcttttcagaaggaaagaccggttctttttctcaagcagaaggagcaactactggagaacgaaattttatttgagttgttagggaatgtcttttatggcgaattggaagatatgacggagctaattgatcgttttcatttatctgaagcgacttttcgtcggtatttgaagcagattcaaccagttttggaagaatacggcttagaattgagtctttatcctcttgatttaaaaggagaagaggcaaatattcgcaagttttttaaagacttctattatgaaggggagatgacgccccatactcttgttccaccaagggatcttcatgaacttgtgcaagctacattctatgataaatttgagtatttctcgattggaacagggacttctcctgctgaattttattatagtttgtatattgcgattgagcgtgtgagacaaggaaaaacgatagccattcctcaaggtctgattgagcgagtaattgctagtgagaattttcgcttaatgtattccttgaaagaagcgattcaaacaaattatcaagttgctttatcagaagaggagttttgttggttgtatttagggttctgttgcaaagttttaaataaagaataaaatcccttacggtatctatgatttaagcttggattcccaataataccttgatttcagtacagaccgaaaacccgaagagagtgccttcttttcgggttttcttatataatcctcgaatggcttccatgcctttaatcgtggtagaggcagtgcgtaaacttcgatagaatttattgcgtctctttactggacgatggtcttgttcaatcaaattattcaggtatttaatggtacgatgttctgtcccttgataaaagccgccgtattcttttagtttcttaaaggcacttgtaatagagggggctttatctgtgactacaaccttcggttcattaaactgcttcactaaccgcttaagaaaagcataggctgcttgtgtgtcccgttttttacgtaaccaaatatccaaggttaaaccatctgcatcgatggctcgatacaaataatgccattttcctttaattttgatgtacgtttcatccattttccatgaataaaaggattttttatttttctttttccaaatttgatagagtagtttgccatattcttgcacccaacgataaatcgtcgtatgagaaacgttaatgccacgatcatataagatttcttgaacttcacgatagctaaggttataacgaagatagtagcccacggctacaataatcacatcctgctgaaattgctttcctttaaaatgattcatcgtcattcctcctgctatctttttctattattctaccttatttgatagtagatttaaaactttgcaacagaacccgtatggagattttccagtcgtgcattcgaatacttcttcagtaatgccagccgaatccctttctcgtatttgaaaaaggcttttttgatatggtgcagttccaatggaacttctccaggcattgctcgaagcagctggaaaaaagtatctggatctttttcctgatacgcagtaagcaggtcttggtagtaacgataagctgttttaagttcaggagaaatctttagaaggcggtcaactacttctgtttcagtcaatagtctccaattgaaattgcgtcttttcgttagtgtattgtaatctaaacgatcctctgattttaaaagtaatttgaataaggatttcaattggcgatactgtttagcttgtattgggtctttttgatcaagtgttttcatcacacgttttcgaaccgcatcgaagaagcggttcagatgttgaacaatgtgaaaccgatcgacgatcacttgtgcatttggaaaacactctttaactagtgagaaataaggagcgttcatatccgttacgatgtaatgtacacccaacctcgctttgagagaaaaacgcatgaaaaaagcaacgagatcttttttacggcggctaggtaagatctcaaacagtttcccggtctcaccgtccatacaagaaaaagaaaatttaccgtgccatgtagaaagagaacgaaactcatcgaataatagacaccgaggtaaatactcaagattctgacggatatctgatgacaaggcggacaatgtccgctgaacagttgtcacagaaacatcgcaatgtttaccaattgcttttatagattgacgctctgtcaattcttctaagatcttgtaatgaatctgcttagaaataaagcagaatggggtaacgagatacgtccgagcggtaaaatattttttacatgctcggcagaggtatcgctgtttcttcaaccgaagataggtccgtttattaccgctacgattcaggagaatcatagagatcttcttgccatttttaacgatttgctttgtagaatctttacaacacggacaacgtctgtaggtacggatcagagttccctcaataacgatactttttctgcttttataaaaagtttcttcaaaggattgaatttggatatttgagtctttaatagtaaagagttgtttgataaaatgattcatggacatacaagaattcccccagaatgatgttgtaggagactctattctaccggaaattttgtatgtctttttgtttttttacaaaaaactaggacagatagaaaatttccatcagtcctagaaattatagagccaataaaacttagtccgatatgcggcgcgttctgtgcgccgcatatttttttagttttcaaagatcagaccttgttgtaaatagatccgtgcccgaaagttataaaagttgcgataaccaaacgcaattcgtttaatcagcttgatcttgttatacagcccctcagtgacgccgtttgagtgggacaccttaaaggcatttgaaatacccgattggtagcgatggaagatcgtgaatttctttttaaacgactgaggtaacgtagatgaaattgttttaagggtttcttgaaagcctaccgtatctcgtttaacgaaataatagcgtaataattgacaaaaatgatacgcagttcgcaattcttcgttgtagcttaacagctcattaacgatttctgtttgactaattggtcgtttaaacagtcgatgataatgccgtttgagtgcctcccatgtcgtggaatctttgagtaagagtttccaatatcgcttgagccgacggtacttcttctgattttcagagtgtgaggttcgaaaacgattcatgatctggacacgtaattgattgaagctgcgattgatgtgttggacaatatgaaagcggtcagttacgatctccgcatttggaaagaccgttttaagcaactgacaatagctggcattcatgtccatcactaggtacttgacctttaaacgggcctttctaggaaagcgcaggaagtattgagttagtttgtaaagtctgcgatcttcaagggtcgtaaatagctgattggttttcccatcaacacaaataaaactcatggaaccagaagtggcaacattgtgtacttttctttgcaatcttgtgtacaaaactattgcaaaacacagcgcataagaatccttacaaaacagtagatgaagcaacccaattagatcttgttatagttgttaatcagctcttaacgggttacgattcaaaatgggtcaacaccctatacttagataagtcacttgaatatcagaacataattcaggctttttcacgcacaaatcgtcttaatggtcctgaaaaaccgttcggaaccattcgttattatcgtaaagcacatacgatggaacagaacattgaagaggctattgagttatactcaggcaaacaagcaaaagggttatttgttgaaaaattatataataacttagaaaagttgaacgatatattcgaagaaattaagtccgtatttaatatttctggcatagaaaacttcagtcatttaccggaggttccaggggaaattaagcaatttgtaaatctttataatcaactaatccattgttatgaatcagcgatgatacagggattcacatgggcaaaatcgacttatgaaatccaggattatgaacctataacagtagtaatcacagaatatgaatttaatatcttggcacaacgttacagcgagatagagagagaacctagagacggaaatgatagtatagcgtatgacattgattaccaattacctgaaggtagtcgtagtcgtattaattatgagtatttaaacacaaacttcaaaaaatacatgaatataaaagaagaacgtgattcgaatttaattcaatcattgttaaacgacttacatcgcacatttgcgcaattaccagtggagttacagccatatgctgagatgattctaaatgatgtaaataatggggaattagttatcaaagaaggatgggaatttactgattacctcaatgaatatcagcttagtgaagaggacgattttatccaagatttagtggattcaaccaatattaatgaggcattattacgtgagatgttggatttacgcttaaccgaggtaaacattaatgaatatagtcgatttgataaattaaaatcaagtgttaacgtaggtcatttcagtggatatatcgagaaaaatttaggtaaaatggtaataccaatcaaggtaaatatgctaattgacagattattgcgtgcatttttattagaagatgtattcgatgttacagagtacataaagaattactttaactagagtacacctacatcttatagtacataaaaaaattcatcttttttagtttaataattcaccaaaaaggtgagtaatgccatttttgaaaattgagcttgttttatgtctacatctgtatccgtatataatccaaaggattataaactcagaagagtctttattttttctgaatataactactgtatcaaaaacaatcgattatgagacaaaacaaaatgacctcttttatttaagaaaggaggtcattttttgtatcataaattgtattaaaatcaatgtatcactttttaatcaattttaagaccataaattgcgtactaaaagaaattctgcaattcaaaataaagcattttaagccattttcaaatttaagtgcacccatctacccgtcaaatcactttattttccactccagtagtttcctaattcaactgtgtgcaaaaacgatttcttctaaacaaatcaagacaaacttataaaccttcatcccagcaccataattatttaaatcataggcatttttcgaaattagtatatgtactcaagtttcactgcagattatttatattttttagagaaataaatttttcctattgacaaacacaaagaaagcggatacaatgcaattatgtcacatgacgttatatgacgttatgtaatatctttacatttaatcagttacttttattttggataaaattaacatttttaaaattttaaggaggaaatgttgatggatgtagcaaaaacggttaacgcaattgtagaaaaaaatgatggagagatttctggaatttatttggtggcttgtggcggttcgctggtagatatgtatgtctcagattattttcttaaagccgaagcatcgaagtgtattacaggcttatatacagcgaacgaatttaaccatgtaaccccaaagcaattagatgataaatctgttgtcattctatgttctcatggaggaaatacagcagaaacggtaaaagcaggagaagtcgctcaagctagaggagctgtgactgttggtctgactcataataaaactgcggatttattaaaggtttctgatcatagtttcctttacgaatggggagatgatgcaaaaatagtcaataatcctatggccatcattcttgatttaactgtatctttggtcaatgttaccgaaacatttgaacattacggtaaattcagagaaggcatgaaggttatcgataccgtaattgaaaatggcattaagcaggtgcaggatcgtattaaagtgtttgctgataagtacaaagatgaaacaatgttttatatcttaggtagtggaccatcatatggacatgcttatggtttttcaatttgctctttgatggaaatgcaatggcttgattcaacttctgttcattctggagaattcttccatggaccttttgaagtaacagacaaagatacgaattttattctcttgatgagcattggacgcactcgtgctttagatgaacgggcaaaacgattccttgataaatatgcagaaagagtagaaatcgttgatgcaaaggaactaggattggatatgatatcagatgaagtttctgaattcttcaatcccattttattctacagtattctttcagaatatcgttcagctttagcagatgcacgcaatcatgatttagatgttcgtcgctatatggggaaagtggagtactaggaggattaaaatgaaggtattaggcttaggtgataacgtcgtcgataaatatgaaaatctgggaattatgtatcctggaggaaattcattgaattttgcagtttttgcaaaaaaactgggacatgaaagtagctttatgggagtttttggctcagatgaggaggcagctcatgttttatcagcaataaaagaaataggactggacaacagtcactctcgctttgaaaaaggcgagaatggctgtgccagagtgaagattgatgagggcgaccggattttccttggcagcaattcgggaggtgttactcgtgaatacccgattcagcttactgaagaagacagagaatatttaaaccagtttgaattgattcatatgggattatatagccatgtcaatcatctattagaagagttacaaaatgtttctggaaagatttcttatgatttttctgacgactttacggaagaagaggttcagcgggcaattgataaagttgattttggcttcttttctatagaagacttttccgatgaagaagtaaagcagtttttgatgaagcatttttgtgagcgaaatgatgtattgattgcaacccgaggagaaaaaacggctattggttatgatggagcaaagttttatgaagtgaaccccgtgctagaagaaccagttgatacaatggcagcgggagattctttcttaacagctttcctactttattttctcgaaggggacgatatagtcaccgcgatgaaaaaggggaatgaatttgctgggaagtcttgtctggttgacggttcgttcggctttggtattcattacgattgagcttgttttaaattcctgcatttgataacctaaagaaagaaatcccggtaaagtggaggttaaaaaaatgctggatacaaatgcacaattaccattgtacttacaattaaaagaaatattaaaaaataaaatcaatacaggggagtatcccgagaatacgaaaattcccgctgaatcagagctgatagaaagttatgaggtcagccgaatcacagtgagaaaagcagtagaagaactggtagaagaagggtacctacttaaaaaacaagggaaaggaacttttgtcaaccggcataaagtttttcgtaaaattgaatatgttatgggtttcagtgagagttgtaaatctaatggttttacaccgactagcattgttttggaacgcaagatcattccagcaactgaagggatggcaaaaaaactcgatatcgctcaaggtgatgatgttttatatatccagagaaagcgaatggcggataacatccccattatgttagaaaacaattatttttcttatgaaagatatagtttcttaatggaggaagagctgactgattctttgtatgaagtacttaaagtccaaggtaccttagccatcaatcctggggaaactgcacttgaaattgtcacagctgatgaccaaattgccaaaataatggaagtagctgttgggacgccctttttctttatggatactttaatcaacgatcaaaacaacataccaattcatgtaggtaatcaatattacctgggagaagtatatcgtttttacttatgatttgctgttttgatttcaaggagtagattttatttatgaagcaaatattgcggtcaaaaatgatttttgatggagagcagccacctttcaaaggttatattgtaatcaatgaagggatcattgaaaaggtggaaaacaactggaattacagtgatctattaaatgaaaacacggaattaattgcttatgatgatcaattcgttatgccagcaattcatgataatcatgtatttttcagtggttatttggctatgaatgctggcatagatttaagcgatacatcttcagctaacgaggctgtagagcgtattaaagctgtaatgaaccataaaaaagcagatgaaccaatttatgctcatggctgggatgctgccctgtggaaaactgacccatcagaagagctattgaatgaaataaaccactttggtccaatcacagcgatcgacaaaaatcgcagccattgttggatgaatgctattgctaagcagacttatggttttacagaaaaagaaaccagtgctgaaagtcgagtattattaattaaggaaatgctagcaaacaaaaagcttttagcagaggtttacgctgaatttgaagcattactgctttcaaaaggtgttatatcaatgaaagaaatcgtttttgatgacgcagaatttctttctaatatacctcagaggaaaatacttagtaacctatatgtgcaggcagtccaagaacctctacagcatgaacttctatatgagtataaggaaaaagttttccctgaaaaggtccgctttggtggagtgaagatcatggtagatggtgttgttgcggatagaagtggagatatttacggtgtttatcagtcaggagtagcttcacccgagattgactatgaggcaattaaagcagaagttgctgcattcaatgaagtagagattccttgctgtttgacaacggaaggagataaagcgggttataaagctgcgtcaattcttgtcgaatttggaaagcggttacctgaaggcgtttttaattcgattagtgatttggaaatggttactcaaaagacagcagaaaaaatgaacgaaggacaagtagtagcagaggtatatccacaaattctcggcttgaatcaaacgttagaagaggcttacatgtcaactgttataaaaaatgagtcaagtccacaatcttgtgtaaaagttcaacctcatcaaaagcacaatgttttgcgttgtgaacctaactgccatgcctttctttctgaggagagaggtcaggagcagtagcgcagcgactcttgatgtctctcctcagaaagaagagactcgcacaggttcatggtgctaaatgttattcgaattaaattctaaatattttcgtggagaagccagccactcagtgtctttttccatcaaaagtgttccaattatccgagtgatggaattgatatttggaaaaatccgaatcactcgttctctccggcgaatctcttcgttcaaccgttccaacacattggttgtacgaatccttcggcggatattttcaggaaaagacaaaatttgaatagcatcttcaaagccgttttctaaaatgtcgcaagcagcacttaattttgaatcacaaccatatttttccaagaagtgctcttttctttcacgtgtcaattcaagttcagaggctttaaagatactcttcaactcgtcttttacatcagaagaaactttctttggcagcttatcaaaaatatttctcaaaaagtgggcttggcatctttgccagctcgcacctaaaaagttcttgcgaacagccttaactaaccctttgtgtgcatcagaaatgaccagttttacaccgaacaaacctcgttgaacgaaacgatgaaaaacggtatcccaattatcttcccgattcgccgtcttgaacatcaaaaccaagaatcgtacgtcgtccatcagaatcaatgccgataccaatatatacaccttttgagacaatacgatgattttcccttactttcatatacagggcatcacacatgaaaaatggatattccgagccttctaggctccggtttctccactcaaaaacaaatggatccaactgtttcatcagatttgaaacgaatgatttagaaacagtcgcaccatccgttagcagttcaactgttttagttactttgcgagtggagacaccagaaatgaccatttcaatcatggcagcgatcaaagctttttcgcttcgctgatatctttcaaagatagtaggactaaacttaccgtctctggttcgtggaacatgaagttctaacgtaccaattcgagttgtaaacgaacgatcgtagtaaccatttctttgtgattgccgttcttctgaacgttcataggcatttgcctgaatatattgatttcgttgttcttccatcagctgattaaacatgatagttataagtgtttttgcggtatcattcgcaccgctttcgtttataattgcttgaatttcttcgctttcaaaagtaaaatgtacttgagtcattgatatcagtcctattcgagtatgttttctgcaaaaaacattgtactcctaactgagatcaatggcttttttgatgcttcacttttacacaattatatggacgtaatcaaaaaatgtttccacagaggacttctttaattattgtcgattagaggaaagtggtgtaacagtcactagcggtacagatttaccgctgtttattactgatattcctgaatcgattataagagcagtattccgtcgttttcctgaaggagaagaagtctgggagaaagaaacaagcttcacggcaaccgagctgctgaaaagttttacaagcaacagcttcaaagtaaatggtttatcggagtacggagaaataaaagtagggaaaagcgccagcttagctgttttcagcgaggacctctgtactgatgactggcaaaaagtgatggctgcggaagttatcgctacctatcttgatggtgacttagtttacaagaaataatgcttttcgatataacgttataaaacgaattaaagagaggttaaaaaatggaaacaatgaaaagaaaattcaccttcccacatagttatacattgatttttatcttaattattttggctgcaattttaacttggataattcctagtggtcagtttgagacagttgttgaaaacgtcgcaggtatggaaaaaacaacggttgttccgggaacctatcaccaaatcgataaggcagattatggacaaggtttttcctctatactaatggcaccagctgaagggattatttcagctgttgaggttgttgcttttgttctcatcgttggtggtgccttcgggattatcctaaaaacgggagccatcgatcgagggctgtttaccttagcaaaagttctgggagacaaggggatcttagttattccgatgtcgatgattctattcagcttaggaggatcaacctttggcatgagcgaggaagtcattcccttatttgcggtgtttatttctctgatgttttctcttggctatgattccatgactgcgatcttgattctatttttaagtacacaagcgggatatgttgggtcgacgattaatcccttcaacgttttaatcgcacagggagtagctggcgtttacggaaatcccctgctttggtttcggatgctatcctggattgtcattactgggatttcaattgttttcaccatgctttatgctagcagagtcaaaaagaatccactgtcctctattgtttatgagagtgatttaaaggttaagcataagtttcaaaattttgacactgaaaaagagttttcaacacaagataaactaattatcgccggttttatcgtaggtttaggaatcatgatttggggtatcatttccaagggatggtatatggttgaaatttctgcactattcttaggattaggtctttttgctgggggcatcgctagattttctcaaaaggaaattgctgaagcttttgtcgaaggctgttcagatttcgcctatgctgctgtaatcattgggctagctagaggagtcttggtaatcttggaaggtggaatgattattgacactattctaaacagcttggctaaccttttaggtggtcttccaaaattcctgttcactacgattctactcatttctcaagtaattgtttccttttttgttccatcctcctcaggagctgcggcattaacgatgccggttatggcaccattgggtgatctaatgaatgtaagtcgtgatgttgttgttctaagtaaccagtttggaaatggtttaatgaatattatctccccaactagtggtgtattactggcaggattagccatcgcagagattaatttctctaaatggtttaaggttggcttcaaaatatttgccatcttaacccttgtttctgctgttttgttatacattgctacactcttttagtcttaatcatccattaataggaggcaatagttatgattaaaataaatcaattagcaggaatgaatatccactatttattttattctctcaaagaatttttcgcttatcaacagaaaattggtatttcttctgttgaactttggggaggtgctccgcattttttcatagatgcttttactggttctgttgcaaagttttaaatctactatcaaataaggtagaataatagaaaaagatagcaggaggaatgacgatgaatcattttaaaggaaagcaatttcagcaggatgtgattattgtagccgtgggctactatcttcgttataaccttagctatcgtgaagttcgagaaatcttatatgatcgtggcattaacgtttctcatacgacgatttatcgttgggtgtaagaatatggcaaactactctatcaaatttggaaaaagaaaaataaaaaatccttttattcatggaaaatggatgaaacgtacatcaaaattaaaggaaaatggcattatttgtatcgagccatcgatgcagatggtttaaccttggatatttggttacgtaaaaaacgggacacacaagcagcctatgcttttcttaagcggttagtgaagcagtttgatgaaccgaaggttgtagtcacagataaagccccctctattacaagtgcctttaagaaactaaaagaatacggcttttatcaagggacagaacatcgtaccattaaatacctgaataatttgattgaacaagaccatcgtccagtaaagagacgcaataaattctatcgaagtttacgcactgcctctaccacgattaaaggcatggaagccattcgaggattatataagaaaacccgaaaagaaggcactctcttcgggttttcggtctgtactgaaatcaaggtattattgggaatccaagcttaaatcatagataccgtaagggattttattctttatttaaaactttgcaacagaacccaatcatttgagaagttaaaacctacacatgaaggtaggtattttagaagattgaatagacaacaccgggttgtttataaggtagatgaagatgaacacgtggttgaaatttattcagcaaggacgcattacgagtcacagtaattacttgtaaatacattatctcgtggtataatgtatttactaagtaattacatactgttagaaatgggggatttaaatgattacaaaaacaagaaaacaaggcaattcaatcatgttgacagtacctaaagattttaatgttcctaatggagtcgaagttgaagcaaagttggtagagaatggtattctttatgaatttgttgaaccacaaaaagaattttatgattttagcgaagatattttgtctgatataattgcagaaggctacgataaagatgagattcttgtagaatttaagaatagaaaaaacaaaatgcattcttcctttagagatattgctgaagatacacttactaattctaaagtaatgactaaagaggagttggcaacagaaattggcttatgaaatcgttccttcaaaacatgtcattaagtatttaaaaaagctaaaagagaagccattgaaagaaaaatttttgaatttaatttatgatgaaattgcgattgatccatataagggtgaacaaaaaactggggatttatcaggtatttggtctagtgggttcaaatatgcgggcacaacatatagagtagcttacgagattatagaaaacaaggttattccagtattgttatgtggaacgcatgaaaacttttatgaacagttgaaaaaattaatctagtgatttgttgtcgttcttaagaaggacggcttcttttttatcgaaaatctgattcgtctacatgactaaagtcgcgagtattctctgcttctcgataaattaaataacgtcattactttgaggaaagctataaatcaatatatttcagcttttccttatttatgtactaccttttacttattaattataaggtagtacatatatatcttttttttggtagtaactaaaaataaatatgttataatagtatcaaatgaatattgctaaaagaaaagaggtaggaacgtggtagcgaagaaatatgtaatcggtaattttaaaggtggcgtaggtaaaagtacgtgcgcgcaaatgttagggtttgaatcagcagttaatgaaggaaaaagaaccttgataattgacttggatatgcaaggaaatacttctgatgtgatgaacttaacgcatatgaacttcactaacgaagaaggaggcggagaaggtgaaccgattgtttacgaaaatactgtgactgacgtgttgataaacaatcttccacctaaagaggctgtctataaagtaatcaataacctctatatacttccagcagacatgtcctttgaaatgtatgatgattggatcaaagaccaatataatgattcattatcccaattcaaatatatgaaagaaaagctagaaccattatttgatgagtttgacgtcatctatttagatgtcccaccttctatttctgtatatagtaaatccgcgatgtacattgcggattgggcaatcgtcgtcttacagacccaagtaaaatcgatgagaaatgcgatgcaatatcttgagtatatggacttttttgtgaaagaatttgatacaaatttatatgttgctggtgttattcctttcatgttggaaagcggtgacgcagtagatcaggaaatgtataaacaagcccaagagatttatggggaacatttgattaaaaatgttgtactcaaaaatgcgcgcttaaaacgatacgacggatcaggtattacgatggagaagacaaagaaaggtctcttaaaacaatgggatcgcaaaagccacgaattatttatcagtattttgaaagaattggaagaacacgagaattggtatgcggaggtggagtaattggctgacatcaaaggacttgatatttttgggaacaacaaaggactcgccaaaataaaaaaagaagcagaagcaaagaaaaagcagcaagcaattacaccatctgaaaataagcaattagaagtgcaccaagttcaagaaataaaaacttcctccaatgttgaaagacagagtagaggaagaacaaaaaaagttggcgcaccaatcagaaagtttgataaggtttattccaccaagcatcctttaaaactgtcgactttgttaaatgcgacttccagagttttagtagaaaagtatgagactaatatgacaagagatgaattgcttagaaaagctttagatgagtatattaaacagaatcttacgcaagaagataagcaagatttgtttaatgacgtggtgaaagaactagacttgttcagagaaaaatatccaattgttccagaattagatgatcgtggagaaataataagaactaccagtcagataaaacaagataccgaagactcactgcgcaaagggtggggaatgaataataaagttagataataatcaaagaagaactaagtaactacctttaaacggtagttacttagttcttctttgatttgcgtgaaatagaggggatttatttttctggttacgtgattaaaaaatccaaaaaatgggttctgttgcaaagttttaaataaagaataaaatcccttacggtatctatgatttaagctgggattcccaataataccttgatttcagtacagaccgaaaacccgaagagagtgccttcttttcgggttttcttatataatcctcgaatggattccatgcctttaatcgtggtagaggcagtgcgtaaacttcgatagaatttattgcgtctctttactggacgatggtcttgttcaatcaaattattcaggtatttaatggtacgatgttctgtcccttgataaaagccgtattcttttagtttcttaaaggcacttgtaatagagggggctttatctgtgactacaaccttcggttcatcaaactgcttcactaaccgcttaagaaaagcataggctgcttgtgtgtcccgttttttacgtaaccaaatatccaaggttaaaccatctgcatcgatggctcgatacaaataatgccattttcctttaattttgatgtacgtttcatccattttccatgaataaaaggattttttattttcttttttccaaatttgatagagtagtttgccatattcttacacccaacgataaatcgtcgtatgagaaacgttaatgccacgatcatataagatttctcgaacttcacgatagctaaggttataacgaagatagtagcccacggctacaataatcacatcctgctgaaattgctttcctttaaaatgactcatcgtcattcctcctgctatctttttctattattctaccttatctgatagtagatttaaaactttgcaacagaaccgacaaaaccaaaaaacagttttgtttcgctttctaaacacgtataaacggcgggaacagaaaaatgaaaaagcagtatattttgccacgggtcattgcagcggcagccactctagctacgcgtcgatcgcatcaatctctaagtgctatgactagataaacggtggttaaaaatcaggctcttcggcaatttcgtaacagccaaccagacaaaaaacatctgttttgtcttctactccaattgctcaaacctgaacgacttttggctcaaccttgattaaacggtggtcaaaagtcagatcttcggccatttcataacagccgctccagacaaggaacgtctggagcgccttttcctccaattgctcaaatctgaacgacttttgcttcaaccttcttgaaggcctgcggaaataagccgaaattgctgataaacacgaagaatgcagtgattcgataatgaacgtaccttctcttggttctcggagcttagcgcttctgtcccagcctcatacttgatcgtacatttacttttgcttctcagagttgaacgctgtcggtttgatcttggagactaaaagttcatgactatttctaataaacacgagttaaatactttttgatttgtgattcgcttgcattgaaacggttgaacttacagcgaatagtttttcctaactatgggattgcaaggtcgtagcaacattaacctgtatgttgcagcggcgactaatagtataacctaaagcaatcgccgccaactccttaccggctcttatttcctctcgtacaaataacagaacctcttctttgtcaactcccagcaagtccgctgcaacgtcattgtcagttattaaagaaatttcttgagaacgcgtatatgccaaacttttaaaatcttggaaaggattgtccgagaaattacttttctttaatgtttccatagggattaataacatcaagctaattgcttctgcatcaatatattctaaataagcttgtggttgctgctgtttgaaatcattcagttccggacaaagagctgctgcttttttcggtgaaagagccgttgcctttagctgtagccgctgcttactaagcagagaatcttctatcggtgtaaagaaatgatgggcatttttttcgaattttggcgcagttaaataatagccgctattggtttgcgcccgtaaggtgccgttgtccaccagtttttgtaacgcgcctcttaaggtagttcgattaacattaaacatttctgataggtcccgttccgaaggcagttttgttccgggggttaaatgatgttcatgaatataagcaataattttgtcaatcaggtcataagccaacagattaatcaatttgggcatagattttcatctcctttccttgatgaacatttttagtatagatggcggcgaattcaggcaaaaccactacttcagtgtattcaaccgcttgttcatttgtcgtaaccgcagtgatagcaagactgattaccggacgatttaagctggtttttaacaaacgggcttctttattgcgcacttttgagctggaaattgtctgatagatattttcaatttgataatgataagcagccaatgtggaataaaatgaaaaaatttggaaatcaaaagcttgaagatcaggtatgagatttaatggaatataagtgtcttcaatagaaattggctcaccgtcgccgcttcttaaacgaaccaaatgaaatacttcttcagttggttccagctgtaaagctttcccgacaatgtgtccagccggttttatttctgaagctaaaattaagctgctaggctgaatcccttcccgttccaacaattcagacaaaccatgaaatttgatttgcaaatgttcatggatattttttttaacaaaagttcctttgccatgtatttttagtaggtactctttatttactaattgttgaatggctttttttacggctgaacgattcatttcataaatttgaacaaaatcacgttctgaaggaatagcttgcgcgtatttatatttttcttgttcaatgtcttgtattaatttgttcgttagttcttcagtattcatacgttacactccagagtctatttttgtttattatacatgaaaaaaggattttggtacaaataaaaataaaagtggttaaaaactattgacagcgttttctataagtggtacattaaaaacgttaacaggtggtatataaaaaagattaagtggtttgttaatgtgccggcatttgcaaatatatttttcaaattattgacttggaggtttttaactatgttaggttttagcgaagaacgttttctatcagtattaaatggtgcagtaaaaaatatcgagacaatcaatcaggtggcagatgcaatcagtgagaagggatttaaaaatctttatttggtaggctctggtggaacatatgccacaatcagcccgctagcttatctgttaagcactcattcagagcttgattattatcatgaaatagccgcagaggtggtttgttcacagccgaaaaagattaataaagatacagtgttaatcacatcttcattaaccggtacgactcaagaaaccgttgatgttgttaagtatgccaatagtcaaggtgcaacgacgattgcgtttgtaggaaatgctgctacaccactcggggaaatcgtggattatgcgattgaaaatgatgctgacaacgatacattagtagaagaacttcagttacagttttttgctttgggtgcacgcctgatgaaaaataacggtgagtttcctgaatatgatgaatttattcaaacattacaaaaaatgccggaagtattactaagtgttcggcaacaaaatgatcagaaagcacttgaatttgcagaaaaacataaaaatacggaatttcatatgtttgttggagccgggaatacttatggggctgcctatgaatatgctatgtgcgtactggaagaaatgcaatggattgccaccaagtcgatccatgcagccgaatttttccatgggactattgaaatgactgataaatctatgagttttgtgttattaaaaggtgaagatcaaacgcgtccgctagtcgatcgcgtagagcgttttgtaaataaatatagcgatgttgtgacggtttttgacactgcggatttcgaattagcaggtgtaccaagcgctatgcgtcagtatgtagcgccaatggttatggcaacggccttagaacgagtgagtgctcattttgaaaaggtgcgggatcattcactagatattcgtcgttattatcggactgtggaatattaaggtaagagctatgaggaaaattgtaattgcgacgcattccatgatggctaaaggcttaaaggatactttagaatttattattggtcctcaaaaatcacttttagcaataactgcgtatatagatagtgactactccattaaccaggaaatagagcagctattttccgacttagcgcctgatgacgaattaattgtgacggtagatttactgggaggaagcgtgtctaacgctttctccgaacaaatcggtaaagacaatttttatttaatcagcggtgtaaatctgccgctgcttttagagctttgcttatcaggtgaacaggacacgaaaaaactaatccaaaaagctatgaatagcgggaatgaagggatagttttggtgaacgagttgctagagaaaacagaagaggatgatttttaatgattaaattattacgagtagatgaacgttttgttcatgggcaagttgcttttgcctggacaaataacttaggtgcaaattgtattttcgttgcaagtaatgaaatcgctaccaataatctgcgcaaaaaaacactaaaaatggctgttcctacagggacaaaatttgtggtgaaggatatgacagaggccatctctgttttaaatggagaaaaaatcaagaaataccaagtatttttaattgtcgggacggtggaggatgcctacgaaattactcagcacgtacctgagattaaagaagtgaatttaggaaatttaaagaaaaacgagaatcggaaaatgattactagttccgtttacttgaatgaacaagaactggacttggtgaaaaaaatgactgaaaacgggataacagttcaatgtcaggctgtaccaacggacaaaaaaatcaatcctttgcatgactaaaagaggaggggaagaatatgatacaagcaatattaatcgcactggtagcttttttggcgtctattgatgaatacacatttggtgcatcgatgatgggtagaccgctatttacagcgccttttgtcggtttgattttgggagatttagagtcaggaattattattggtgccaccttggaatccatgttcatgggctcaattatggtagggagtgcgacgccccctgaagtttatgcttccagtgttttaggtacagcaattgcgattcaatcgggtcaaggagtaggaactgccgttgcgttgactttacctttgtccatctttcttcagatgtggcgtaacttcgcctatgcaatgccaattacgtattttaacaacaaaatggatgaggcattagtcaatcatgatttcaaaaaagcacaaaaatatcattatgtggctcaacctttaatcgttggggttccatcggccattttagtttttgtagctacttattttggtgtgtctacaatcaatgcgatgatcaagttgattcctcaggttgtattggacagctttgatgttgcggccggtgtgctttcttgtgttgggctagcgttattaattaaaatgatggcgaataaagcgatgatgccttatcttttcttaggatttgtcggcgtaatgtatctgaaaatggatgttgtcggtgtggctgtcgtcggactttgcttagcgttactggctgttcaaaagctaacttttgaagaggaggaagatttataatggtaaaagaaagtgttattgggaaaaaagaattaagaagtatattttggcgctccttttttatgcaatcctcttggtccttcgataaaatgatggcatatggacaaatgaatggtattgaacgttccttacgtaaaatatatccgaacgatgatgattattatacagcgttgcagcgccatacggaaacatttaacattacaccgcatattgcgccttttgttatgagcttgtccgtcaccatggaagaagaaaatgctaaaaatcctgaatttgatacagacgcaattaataaaatcaaaacaggattaatgggacctttatcaggtattggcgattcatttttctggggaacttttcgggttattgcggctggcataggtatttcttttgctcaacaagggaatattttaggcatgatcctttattttactttgtatactgccattcattttatttttaaatggttggcgacaaaatatggctatgttttaggaactaaatttattgatgatacagaagacaaccatatgattgacaaattatctcatggtgcttcgattttaggtttaacggtaattggcgcgatgataggcacgatggttactttaaatacgtcactaaaattcacggttggtggagctgaaacttcattacaaagtatttttgatcaaatttttccgggcttgctgccattaggaattacctttttatgcgtctggctttactccaaagggcataaaacgatcacaattattctaggaatttttgttttatgctttttaggtacacttggcggaattttttaagaaacttggaattatagaagtaaatatttgttcttaagatttacatttattcaacagtaaaaagaacttgtaaaagtaaccaactaaaaagtagttttgctttgatcttagaaacaaacagcaaataaagtttaggcttacaaactgtttagagtaagaccaagccaaaagtcgctaagatttgagcaattggagtagaagacaaaacagacgctttttgtctggttggctgttacgaaatggccgaaaatctgacttttgaccaccatttatccgaacatagcacctagagattgctgcgatcgacgcgcagctagagttgctttcgacccaccgtttattcggatttagactcactaaaagtctgggaatttatttatgtctcagactctccttattatttttgtgcatttcttctgatggtgttaaaccgcgaagatcaccgaggtttgaggatgaatggacctgctcgtggtttttgtcgctttaagctgatgttttgcgccggttctgttgcaaagttttaaataaagaataaaatcccttacggtatctatgatttaagctgggattcccaataataccttgatttcagtacagaccgaaaacccgaagagagtgccttcttttcgggttttcttatataatcctcgaatggcttccatgcctttaatcgtggtagaggcagtgcgtaaacttcgatagaatttattgcgtctctttactggacgatggtcttgttcaatcaaattattcaggtatttaatggtacgatgttctgtcccttgataaaagccgtattcttttagtttcttaaaggcacttgtaatagagggggctttatctgtgactacaaccttcggttcatcaaactgcttcactaaccgcttaagaaaagcataggctgcttgtgtgtcccgttttttacgtaaccaaatatccaaggttaaaccatctgcatcgatggctcgatacaaataatgccattttcctttaattttgatgtatgtttcatccattttccatgaataaaaggattttttatttttctttttccaaatttgatagagtagtttgccatattcttgcacccaacgataaatcgtcgtatgagaaacgttaatgccacgatcatataagatttcttgaacttcacgatagctaaggttataacgaagatagtagcccacggctacaataatcacatcctgctgaaattgctttcctttaaaatgactcatcgtcattcctcctgctatctttttctattattctaccttatctgatagtagatttaaaactttgcaacagaacctgttggaagatattcttagaaaaaagacaaaacttttagaacacgaaaactatattgaacgaataaaatgaaaaaatgattaaaaaatcattttattatttacgtttacattctaatatgttaaattgaatataacttaaacaggcatgtgactggtaatgcaggcaggacctaaataagttgaataacaatgtatgcgtttcaatacacgtttgccttgttgtcaatttatttagtttctgcctgttttttgtgttgaggatggccacttcgactcaaaagttcatcactcaaaaaagaaaagagggaaacaccatgaattacaaacaaacagcagaagaagtattgcagtacatcggtggggaagaaaacatatcccatttggagcattgctcaactcgtttacgttttacgttaaaagacaacagcaaggtaaatatgagccagttagaaaaagtggatggcgttatgggcgttcgccaaaatgtgcaatgccaagtaatcattggaaacgatgttgttgaagtgtatgatgaagtgaaagcgttattaggtgacaatgtttcaagtactgaagaagcaccaaaacaaaaacaaaaattaggttcagttctattagattttattatttctattttccaacctttaattcctgcgattgcaggtggaggagtattgaagtccttgttgctactagcttctatcttagggctgattagtgaccaatctcaaacctatcagattttaaatttggtcggcggggcaccgctttatttcttgcctattctggtggcaatgactacggctaataaattgaaagtcaatcaattggttgcagtatctgctgtcggtgcattgatccttcctgaaatgacagctatgttggcggaaggtgctacattcttatcttttggattggataatatagcgtatgcatctcaagtattcccagccatcttaactgttttattttatgctcaacttgaaaaatggtttacaaaagtttcaccaaaaccaattcgtattttctttgtacctatgatgagtttattgattacagttcctattgctttgttgcttctaggaccattaggttataatgtaggaacagctttctcttctatcattgtgtctttgtacaatcaatttggatgggttgcaaccggagtcttagcagctgtactgccattaatggttgtaacgggtatgcataaagcaatgatcccttacgctgtttcatccatgagtgaattgggtgcagaacttctttatctcccggcttcattggcacacaatatttcagaagctggcgcatgctttgctgtcagtatcaaaacaaaagacaaaaaattgaaatctacggctgtttctgcgggtatatctgcattattcggaattactgaaccagctctttacggggtaacgattctgcacaaacgtgttttatatgccgttatgttttctagcctgatcgggggagcatttgcaggaatcgttgcacttcaagcctttgctttagtgggtcctgggattgcaagtatcacgatgttcgctgacaaagctgacccaatgaatctggtttgggcatttgcagtatcggggatttcatttgtggttgcttttgctgcagcgttggttctttataaagataaagaagttgtcaatgaagttgaaactaagatggaaacggccgttgtttcagatgctgttctttcaagtcccgtgaatggaaaagtaatctcactatcagaagtaaaagacactgttttttctagtggtatggtaggtgatggagtagcaatcattcctgaagaagggatattagtagctcctgaagatggagaaatcacaatggtatttgaaacgaagcatgctattggtttaaaaacggctaatggtgcagaacttctttttcatattggtattgatactgttcagttagaaggaaaagggtttgaggcatttgttcgttctggtgaaaaagtagccaaaggacaaaagctgattgcatttgatattgatttaatcaaagaagcaggattcgaccccacagttatctgtgtggtaaccaataaggataattacactatccgttcatttaacctagaaaaattggtaaccaatgatagtgatctcttagctatcagtccgatagcttaaacacaagatagtgaaaaaaaatatattgaatgaaggaatagaggagaatagaataatgacaaacacaacaagttttccaaaaggatttttatggggcggcgcgatagcagcaaatcaagtagaaggtgcttggaatgtagacggtaaaggtctttcagtagcggatatggctacttataaaccaaatttagacaacaaagattttgctgctcatatgcatgtcaccctgcagtctataaaagaagctagtgaagacaaatctgataaatggtacccaaaaagaaggggcgttgatttttatcatcactataaagaagatttagctttatttgccgaaatgggctttaaaaccttgcgcctctctattgcttggactcgcttgttccctacaggagaagagctggaaccgaatgaaaaaggggttgcattttatgaaaacgtctttaaagaaatgcaacgtttaggaattgagccgattgtgacactatctcattatgaaatgccattagctttagcagttaaatataatggctgggtggagcgtcgagtaattgatgattttgttcgcttcgctaacgtttgttttgatcgcttcggcaaatacgtaaaatattggctgacatttaatgagatagacagcatccaccgtcatccatttacaacagctggaattatccaagagaaaagcgcagaaggtcaagaagctcaagatatctatcaagcattgcatcatcaatttgttgcgagtgcgttagtgacaaaagatgctcatgaaaaaattccaggaagccaagttggttgtatgttaacgaaattgatgacttatccattaacttgcgcaccagaagacgttgagctgaccttgaaaaagaacttagaaaataatttttatgcagatgttcaagttaagggagaatatcctgctctaatcgaaaaggatttggaaaatcggggaattcagattaaaatggaagatgaagatcgagaaattttaaagaaacataccgtagattttgtttctttcagctattacatgtccatggcagaatcagctgatccaaacgcagaacgcacaccgggaaatactgttttaggggttaagaatcctcatttgccttcaacagattggggctggcaaatcgatccaaaaggtttgaaaatttcgttgatcgaactttatgatcgttaccaagtaccgttgatgattgtggaaaatggtatgggagcagtcgatcaggtagtagatggtaaaatccatgatccgtaccgcatcgactactttaaagcacacttccaacaaatgaaagaagcaatcgatgaaggtgtagatttgatagcttatactagctggggaccaattgatttagttagtgcaggaacttctcaaatgtctaaacgatatggatttatttatgtggatgcagacgatgaaggaaatgggacatataaccgcttgaaaaaggattcgttcaactggtacaaagaagtgatcgaaacaaacggtgcatccttattcgagtagtctcgatctttttaagcagcgatagggggataatgagtgatttcaataaaaaaagtattgaattcaagtgtggtactggttgaagaaaatggcaaagaaatgattgcattaggtaaagggataggctttggacagaaagctggggatgaaatatcaggagataaagtagataaaatatttctgccttttgaagaaaagaaatcttcacaactattagagttagttgaagaaatacctattgaattttttgaaatcactcgtactatcgtttttgaagcagaaaaaggattagataaaaaactgaatcctggagtctatttaaccttaacagaccacctgcattttgcagttgaacgcgcacaaaaaggggtaaatattgcaaaccgtttgtactgggaaataaaaatctactatcccaaagaatttcaaattgggaagtacgcactcacccttttgaacgagcaatatggaattgatcttcctaaagaggaagcctcaaacattgctttccatttgatcaatgcacaatcggaagatcctgatagcggcgctggattcaagtatgcaaaaatgatcggcgggatcgtcaatttggtccggtattcgttgcagaaagatatcgatactaattcgatccattatgcccgcttcattacacatgtacgtttctttgtagaaagatattattctgatgctttgttggatgatggtgaggaagaattctacaatcaaatgtggatcttatacccgtctgccatggaaagcgcagctaagatcaaagactacattgaaaaagtttatcataaaacaattccgaacgatgaagttgtatacctaggtgtccacatcaatcggttgatgaaacatgctaatgggtgagcgctcagtaatactattgatgcttttaaaatctttagagatggattatagtaaaaacaaggtgatttccagctgtttgttatctataagagacatttaaaaaggattaacgtaagataataaaaaatctcggctctttgtcaaatgatgttggtaaagagaaatcttagaataatttggacagaacagaaagaagaaaacctctttctgttctgtttatttggttaaaaatgttttgccatgacgaatcataattcgtagtttgaaattgtaaaagttgcgaaagccgtacgcattgcgttttaatactttgatgtggttgtttaagcattccaatggtccgtttgaatagctgtagtgaagcgcattttggatctgtggcagaaactttttaaacgttcgtaaagtggttgtataggtttctggcagaccgctaatgtctctagttaaacaatcctcaaatagtgactgatctcttttctttaccgcataaagaatgtcttggtataactgatagccttggcgtaagttgggacaagcagctaacagtcgatcggcaatctcactttcagtcaaataatctttaaaactggcacgccaaacccgtttttcatagtttaactttgcttcttctttttgtaggagtttccaatagcgcttcaattttttccctaaccctcgttgagagtgggaatttcctttaagtcgtaccgtggtttctttcactcgatgattcaagaaagttctgccaatatgttggacgatgtggaaacgatcgatgatcaactgagcattcgggaaaagctttttcaccaacgaaacataaggcgcatacatatcaataataatcaattgaacggcttcacgagtcgctaatgaaaacggagaaaaaaaagcggttttaaataaggcaagcgtcgattttcgacaatatccaatatggcatggcttttgtccgtccatcatgataaaactcattgcactggcaacacttcgaaccgatttgaattcatcaaagcataagacctttggcaaagtctgtttgaaaggattcagtgggcggtagaatcgcttcatgacacgatagaccgaagaagtggaaatatttttctgacgagcgatttccgtcatggaagtattctcttttaagcgagcaatgacagaccaacgaactttttgactaatgaaacagtgtttttcagcaacagaggtatccgctacgaatgttctttggcaagacttacatttaaatcgttgtttcttcagctccagataagtgcgatactcagacacatcattcagtaacaaccgaacggttgtcgtcccccaacgaatgatcctagaggggacgacacaaagacaatgggaacactcttctggcttgtacagaagagttcctttgtaaatcaagcaaatttgccctttgtatttttctttagttaaacaattttcctcgaaatagatatttaggtctagaatatttagggtatctttgataagctgagtatgagacatcttgaatcctcctatgaattggtagccaaattaattctaaaggatttcagggtgtcttttctatatttttttatacaaaaaagatgttggtgaagttcaccaacatcaaaaagtatagagccttaacgattagttagtaagtggattttatttttttggaacagtgttgcgaaaaaataatcgtaaactgaatgaatttcgcaacgctgtgtaaaacggtttcaaatgtattgtttatctattaatagcacgctatattcaaattatcaaaagagaaaatgttctctaaggaggaaagtagcatggggtataaagaattaggaaaagacatattagcaaatgttggtggttctgaaaatgtaagcagtttagcgcattgtgcaacacgacttcgatttaaaagatgacagtaaagcagatgaatcagctattagaaatcttaaaggtgttgtaggtgtagttaatcagggtggtcaatttcaagtcattattggtggagatgtaaaatttgtatttgccgaaatcgataaactaggagatttttccgcttctaaagaaagtagttcagaagcaaacaataaagggattgtatcaaaagttttagatacaattgcgggtatttttgttccaattgttccggcattaacaggtgcagggatgttaaaagcattattagctctattagtcatgttggaatggatgacaccagaatcgcaaacctatcaatttttaaatttcattggtgatgcagccttttattttttaccggtcttattagctagttctgctgcaaaaaaattcggatgtaatcagtacattgcaattaccttaggagcaattttgttacatccgacttttacagcaatgattgcgggtgctagagaaacaggtgagtccttagctttattcggattacctgtgacgttagctaactatggttcttctgttattccgattattttagctatttgatttatgtcatatatcgagccgattatcgataaattgatgcccaatgctgttcgaatatttatgacgcctctgttaacattgttgattgttgcaccaattaccttaattgtgattggtcctttgggtacattcttaggtaatgggttagggtcacttattgaatttgttaatacgtatgcaagttggttggttccattacttgtgggtgcatttactccattacttgtgatgacaggtatgcattacggtttaattccaatcggtattaatatgttagcaacatctggatttgatactgttgctggtccaggtatgatggtttccaatattgctcagggtggtgctgccttagcagttgcctttagaacaaaacaactttctgtcaaacaattagctgtttcttcaggtctgtctgcttttatgggaattactgaaccagctttatacggaattaatatgcgattcaaaaagccgttaattgcttcaatggtaggtggtggagcagcgggactatttattggaatcatgggtgtcggtcgatatgctcaagttgctcctggcattcttgcgttaccaagtttctttggggaaaaaggactatcaaattttatttacgcagcgattggttgtgcgattgcatttgttgtcggttttattgcttcattcattttaggtattgatgaagagactgaggaagtaaaagaagatacgagcgaaattccagtaaatattgcaagtgacaatcgccgattgtaaaattaagctagacaaataaaaaagtcatttatgctacactcaagatagttcccgcaaaagaattataaggagtgaagacaaatgacctatacccatcttacatcaaataaacttgcaatgatagaggcgtattataataatcatcaatctgtagccaaaaccgcagtactattgaatagatctagacaaacgattcataaagtttaccaatttttcaaaacagggcacaatgctctagattatttcaatcaatacaagaagaataaaactcgctgtggcagacgtcctattgtcttatcagataaacaaacagaatatattcaaaagagggttgttcaaggttggacacctgatgtgattgttggccgtgcagagttttctatttcttgttctatgcgtacactttatcgtatgtttaaacaaggcgtatttgaagtgactcacctacctatgaaaggaaaacgtaaagccaacggacacaaagaaactcggggaaaacaatcttttcgtcgatcacttcgtgacagaggaaatgattattctaaattcaatcaagaatttggccaccttgaaggggatactattgtgggtaaaaagcacaaaagtgctgttattaccctcgttgagcgattatctaaagtaatcatcactcttcagccagaaggcagacgagctatagatattgaaaatcgtttgaaccaatggatgcaatcagtacctaagcatctattcaaatcaatgacttttcgctaattgtaaaattaagttagaaaaataaaaaggcatttatggtacactcaaattgtatttccgacgaaagaaaacaaaggagtgtaaccataaatgacctacaaacatcttaccatagacgaactgacaatgatagaatcatattatcttcaacataataagccggttgaaatcgctaaccgaatgggacgtgctatacaaactatttataatgtagtcaataagttcaagcaaggcaagactgctcttgattattggcaccagtataaagaaaataagaaaaaatgtggtagaaaagtcattcaattacctgctcatgaagtagattacattaaagagaaagtcactcttggttggacgcctgacgtcattatcgggcgaaaagaaaggcttgtttcatgcggtatgataacactttatcgtttattttctaaaggaatatttgatattgacacactaccgatgaaaggtaaaagaaaacccaatggccatcaggaaaaacggggaaaacaacagtatcagcgctcaatccatgatcgacctgataattatcctgatttcaattctgagtttggtcaccttgaaggtgatacgatcgttggcattcatcataaaagtgccgtcattactttagttgaaagattatctaaagtcattatcacgattaaacccaacggccgtaaggcattagatattgaaactgcccttaatcaatggttttctcgcttccctaaaaacttctttaaatctattacgtttgactgtggaaaagaattttctaactggaaagccattagtaaccaacatgatattgatatatattttgcggaccctggaacaccttctcaacgcccattaaacgagaattctaacgggattctgcgtcgtaatggactgccgaaatcaatggattttagagaagtgaatcagacatttatttccagtgtcagcaatcaacgtaatcatattccaagaaaatcattgaattacagaacaccaatcgaaatatttttgagctatgtacaagaagcattttattctagcttaatttgacaaatcataaaagaaagaactgtgtgattcctttagctatcagtatgagtttgctaatctatacccatgttctctccacttttatgagtgtgattgttattggcttcttgtttatcggctctcttttctctaagcgaaaagagaaaaaagaaatgtcggatctgatattaaatatgataaaagctgttggttggaccattcttttaacggcttacgtttggtatccgatgttacaacaagtcctacatcaaaaaattaatcgtccttttcgcacaaatcttcaagaaagggcattgaatatttctgatagtttaatcggtgcagtaaataatgatttagttacgtttacaatgggaacaattggtgtggtttcattgattcttccacttttctttttaaaaaaatttaccaataaagaaaagattatttatttttgtgcagtgaccacttggtttttatcaacgaatctttttccatgggaaattttacaaaaaacacctattcaaatcattcaatttccgtggagaatcttgggttttcaagtgctttttggttcattaatcttaaccatagtgtttttaaagtggaaaacaagcaacaaaaaaagtatgtggagccttgtaggaatagttcttattatttttactgtgactgcagcaacagaagcaaattattcgcataaaattcagtcgtataaaggtcgtttagttatgaccaaaaaagatgttacacgttatacatcctcaagaactggaggcctatatgactatgcaccattagatgcattgaaatataaagatcatttaaagaaacatgaagtaaaagttggtgatcgatggagaatgcatctcataaagcatataattccaaaatagtctatacagtagaagatgccgatgagcaaaatatcacattacctgtattcaattattggggaacagttgtgaaagtaaatgggaaaaagagcactatagaaaatgacaatggtttagtgtctattaaaggtacgggaaaaagaactatagttgaggtttcatctacgtatccaactacgatgattctatctttattaattagttcaataacttttatattcttatttacacgttatttaataagatgctgcggttaaatgaaaatagattagatagatattataaatatgttgattctattttcatagcaatggagaaaatacattagcaatatataaaagaaggtatcaagagtcacagtgaatttattccgaaaagtgaaaagagcaaatataaaatttaataaaaatatagaactaaataggaaaacgtagacgtaattttctacgttttccttttcatatatattaaatattacggaaaatggaatggcaacagtttttttgacaaattttataaggtgcagaacttctttccgtatgctattccgattgtccttgacaatgagcctcctcggatgtgacgatcttcggcaggagctaacagttaaagttagactgcctcgctagcgttagcacatccgagctcattatcaaggattcgctgcgccaatctctggttacggtaaccaaccggtgtctcgtagccaagtgtaccgtgcaaccgaaggtggttccaccaattgacatagtcaaataactccaaatccaattgttgtaaggtttcaaatgtgtattgatagacaaattctactttcaacgacttataagttgattcagctacggcattatcaaaaggacagcctttatgactcaatgatcgattgatgtcaaaagttgttaataattcatcaatagcttggttatcaaactcttttccacgatcagtatgaaaaatctcaacctctgtcagaggttgtttgatacggctaaatgctttttttactagaacggcatctttatgttctccacaagaatagccgagaatttctcgattgagcagatccaaaatgaaacagacataattccattttttcccgactcgtacataagtcaagtctgttacgatcgcttctaatgggttgtctcttaagaatttacgattcaatacgtttgtcgttttggcttcattgcaagtagaatgatgtactttaaaataagcaacagtatagctcgattttaatcctctatttttcatgattctactaatttttcgtcggctgatctgaatgcctcgttttgataaggctttttttatttttcttgagccgtaggcctttcggctgcggataaattcttcagcgactacttcttcaagttctgattcgtctttctttggttttgattgataataataggactgacgtgatagacctaatattctgcacatcgctgatatagggtaaagatgcttattcgcatcgattacttgtctcttcgtccgaatatcagcgctgcttgctttaaaatatcattttccatttctaattgctggtttcttttacgtagttctaacaattctttttgttcaggcgtaagattatctttttctttgaatgaaccactcgttttagattgctttacccatttgtcaaatgctgaagccgttagttcatattctcgaatgatttctacacgtggctttccagctaagtaaagattgacgatttgttgcttgaattcttgtgaaaaagttcttcgtgttctcttagacataaaaattcctcctggtatgttttcttctagtctacacaccttaatttttctgtctagttaattgtagcctatccactatcaagtacgctctgttcccaagaagctcccacttcaagcgttaagaaccgtcaggtttagctaagtgggggtagttcactaaaacatataagttgaaatgagcagcatttttgataaaatagtactcgtaaacgtccatactatagactttttaggtactgtccgttagtgaagtttcagaataagaaagtcataaaaatcgacaccgtgtcaaccaacttaacagagtatcggttttctataattgtttaaaaagaagttatttttttgccaaccttaaacaatctataacaccagcttgatcccttaattttggaaaaaaatttcggaagattaacataattattcataattttagtaaattcgcggtgaattttcttttgcaagtgtatctgtttcattacaccgcaccctagaagaatatctggtgaaaacatcattgtagtattataaatgcattgtgcaacataaaaagcttcaatttcctaaaaaggatgatcttcaggtaaatcttgacctttaatagttcgtcgagcgaggcgtgaatatggcaatcgcttttttagaattaaattttcttcgagttggtcatttcgtttttgtagctgtttcatctgatgagccgtaaggaacgtgtcatcgtcaatttttacttcataatattttttacccaacgcgcaatcgaagaaagagcgatgctgtaatcctatataaagcattttgagttttaccactttcgtgaagtttaacaatggattttgtgaactatcctcacttaactaaacttaacagttcttaacgcttaaagtggtagtttttattagtaattgatagtagttaacatgattttgatatttacgaagaaaatgatatgcaaaccagtccgattttactacaaaagaaatatattcgtattttttagctccttgctgacgatcaacatttctttagatgagacgttgggatattttataaatcattcacatatgagttagacagtcaatgcatatcagatatgcattgtagaacggattaaaatatcgtggatgaaattatagatgaattaaaggagacaattaggaatttatggaggtaatataatgagaacatataaaaataaagaagaattaaaaaaagaaataaataggacttatactaaatatattttagaatttgaaactattcctgaagaattgaaggataaaagagttgaggaagtggatagaacacctgctgaaaatttagcatatcaagttggttggacgaatttaattctaaaatgggaaaatgatgaaagaaatggattatctgttaaaacgccttctgatcaatttaaatggaatcagttaggagagttatataagtggtttacaaatacctatgcacatctaccattgaaagaattagaggaaattctcaatcgtaatattgatgatattaacatgatgattgattcaatgagtgatgaagatctattcactgcacacaaaagaaaatgggcagacgaggcaaccaaaacggctgtatgggaagtatataaatttattcatgtaaatacagttgctccatttgggacttttagaacaaagataagaaaatggaagagattagctttgtaaattcccgtttactgctaagcaattgtggaaaggagacctcttgtatgttaacagtaagaacatacgactacataagttctttgctaactgccggtttttattgggtgaatgcaagtgcactcccctagaatgccgtagagggtgcatcgttagattgtatcaattttggttggccaacagataaaccatgactcacttcgataaaatgagattatggtgccatatccgctgcaaagggacttaggagactagcaggggaaagatttttttatttttgggatgtttttcagaccgccgatagtaccgacaattccctttaaatatggaatctcaacaacccacatgaagggtaggtagcgtcaagaattatgtgtaaatggaaaatccattctgttaattatagttaaatcatcgactctaatgtatcctgaatttctttaaatcccttgtgaattctacctaaaaatttttggttatattgattaaattgagaaatgaagaatctctctagagattcttcattagggaattgttcttttcttcgagtatatcgttttagctgcttattaaagccttcaatcaggttcgtcaaataaattgttcgtctgatggcgtgagggaaattataaaaggttaatagggcaggattcaagagtaaattgacgactcttggatactgctttttccatttcctagtcataaagtcgatgtgatccaatgcctcttcttttgaattcgcttggtaaaccaatttgaaatcctcacaaatttcttttcgatctcgaacacgaactttatgagcgatatttctagatacatgcacacaacattgttgaaattgggcattcggatacacactatggatactttcttcaatacagcttaatccgtctgtcactactaataaaacttcttctaacccacgttttctaagatcttgaagaacttctttccaaatataagcagactcagttggggcaatagtaaacccaagaacttctttggttccatccaaacgaataccaatcgtaatatacactgcttccttcgaaacagtctgtcgcttcacagggatatgcgtcgcatccataaatataacggaataattggcttctaacgttctttctttaaaagctaaaacatcttcagccaccaatttactcatgttggagattgtttgtggcgtatagtggtgaccatacattttttcaattaatttggagatttcagccatagtaatgcctttttgaaataattggataatggtcgtttctaatgaatcattggttcgcttatatgctggtagtgtttgttgagaaaattcgccattccgatctctaggaatagttaaattcaactcgccatattctgttttaaatgtacgtgaataattcccgttacgggaatttcctgaattgaatccatttcgatcatatttttcgtaatctaaaaaagcagttagctctgcttgtagaagtgaattaatcgctcgctctaaatgatcctgaaataattcatctaaatcccctttattgagtagtgtttgcataatttctatagtaaatttagtcatgagaaagtcctcctataaaatttctgtgtggtaactttaattttacagaatggacttttttttctaccctaaatttctatttacacaaaatattttacgctatcttttattttaaaatatgggatattatgataaattaactatggatgatatttgaaaaaaccatactgtatatttgatttaatttttatttttaagctcatatcgtaagaatgggacttgtagtctcacttctttatggaggtgataattatgaacgttggttttattggagccggcaaggtaggttgttcattcgggaagtatttccaggaacataaaatacaagtaacaggattttatagtaaaagcgaagactcgtcattagcagcttcgaattttacatctagtaaacaatatttaaacttaagagaattagtagatgaaaatgatactattttcattacgactcctgatggtcaaattcaggaggtatggcaagaaattaaaaattatcaaatcaaaaacaaattaatctgccattgcagtggtgcaatatcttcagatatcttttcaaatatacaggactatggtgcttatggctattctgtccatcctatgttttcaatatcagataaatataattcatacaaaaaattaaaaaaatcttttataacaattgaaggcgatgaaaaatatgcaaagtttttatgtgatttcttcaaaaagttaggtaatagtactgtaattgtatctaaggagaataaatctctttatcatgccgcatcagtagtatctagtaaccttgtgctaggacttattaatacaagcgttacatatctaattcaatgtggatttactgaaaaaatggcaattgaagctttatatccattaattgaatttaatattagaaatataaaagaaaaaggaattatagaaagtttgacagggccagttgaacgttgtgatatttcaacaattaaaggtcactgtgaagttttatcagatgaagacagagctttatatatgctattatcaaaaaatgtattagagatagctatgttaaaaaatattaatagagattatagtgaattagaaaagtatttaggagagagttaggagagaaatagatgaaaaatacagcagttacatttaaagaatctaaattaagaaatgaaaaattaacaatgcttacagcttatgactattcaacagcaaaaataattgatgaagctgggataaatggaatattagtaggagattctcttggtatggtatgtctaggacatgaagatacactttcagtaacaatggaagacatgattcatcatactagagcagttacaagaggagctaagaacactttagttgttgcagatatgccatttatgtcttatcaaacttcagtatatgattcagtagttaatgcaggaagattaataaaagaaggacgagctcaggttgttaaattagaaggagggatagaagtatgcgataaaatagaggctatagtaaaggcttctatacctgttatggcgcatataggtttaacacctcaatctgttaatgcatttggaggatttaaggtacaaggaaaggacaaggaagctgctaaagaattaataagagctgctaaagctgtagaaaaagcaggagcattcgctgtagtgttagaatgtgttccaactaagcttgcagagttaatttctaaagagatatcaatacctacaattggtattggagcaggtgcagggtgtgatggacaaattcttgtatatcaagatatgttggggatgtatagtgattttacccctaaatttgtgaagaaatatgctaatttatcagaagagatgaataaagcatttacaaaatatatagaggaagtaaaagatggagtttttccaggtccagaacatgggtttaaaataagtgatgatgttttagaaaaattatattaaaaggggcaagaaatatggttatatttaaaacagtaaatgatgttagaagtcaagtaaaagagtggaaaaaacaaggcttaaaggtaggattagttcctactatgggatatttacatgaaggtcatgaaagtttaattagaaaagcatcaaaagaaaatgataaagttgttgtaagtatctttgtaaatccaactcagtttgggaaaaatgaagatttaggtagttatccaagagacttagaaagagatatagaagtatgcacaagaggtagagcaacagcaatatttaatcctgaagttgaagagatgtattgtgacaatgcaagtacttttgttaatataactggattaacagaaggtttatgtggagctagtaggccaatacattttagaggggtttgcactgttgtaagtaaattatttaacataataccagcagatagagcttattttggagaaaaggatgcacaacagttagctgtaattaaaagaatggttagggaccttaatattgatatagacgttgtagggtgtccaattataagggaagaggatggactagctaaaagttctagaaacacatacttaagtttagaggaaagatcttcagctactattttaaataaatctttaactttagctaaggaagctttaaataatggagagagagacagcttaaaaataattgagataataagtaaaaatataaatacttataatttggcaaagattgattatgtagaagttgttgattctttatcattacaaagagtaaattatattgaaaaatcagttttagttgcaatagcagtatttataggaaaaacaagattaatagataattttacatttgaattacaatagggggctataatgaaagttacaatgttaaaaggaaaaatacatagagctacagttgaacaagctgagttagattatgtaggaagtattactgttgatatgaatttattagaagcagcaggaatatatgaatatgaaaaagtacaaatagttgatgttaataatggaaatagatttgaaacttatacaatagctggagagagaggaacagggatgatttgcttgaatggagctgcagctagatgtgtatcaactggagataaaataattttaatggcatattgtgaattaaatgaaaatgaggttaaggatcatagacctaaggttgtttttgtcgatgataataataaagttgaaagagtaacatcatatgaaaaacatggaaggttatcagatataattctttaggttttgtaatgttatttatatatagctagactattattgaaatatttattgattactaattggatagatgtcaataaagtagacacaaaaagagaagatacagactgtagacaaagtccattttatgtgaatcggctacactagactagacagaaaaaataaggtgtgtagaataataaaaaacacactggaggatttttcatgtcaagacgtcaacgaagaacctcttcaaaagaattcaaacaacaaatcgtcgatctctatctcgctggtaagcctcgcgcagaaattattcgagagtatgagcttacgccttcttctttcgataaatggatgaagcaagcacaatcaacgggctcattcaaagaaagagacaacttaacaccagaacaagcagaattgatcgcactaagaaagaaaaataagcaactcgaaatggagaatgatattttaaagcaagcggcgctgatattcggacgaaaagacaagtaattgatgccaacaagcataaatattccatatcagcgatgtgcaaaattctaaatatttctcgtcaaacctactattatcaagcgaaaccgatcgaaaatgagtccgacttagaagagatcgttcaggaagagtttattcgaaaccgaaaggcttacggtacccgaaaattgaagaagtgtttagcaaagcgtgggcttcaattcagtcggcgccggatcggtcgaatcatgaaacgccgcggattgacatctacctatacgatcgctcattttaaagggcaacgaacagcttgtaatgaagcgaaaacagcgaatgtattagatcggacctttacacaagaacagccattggaagccatcgttacggatcttacttatgttcgcgtggggaaaaagtggcattatatctgcttaatacttgatttgtttaatcgagaaattattggttattcctgtggtgagaagaaagatgcctcattggtaaaagaagcctttggacggataccgtattctttaacagacgtcaagctttttcatacagaccggggaaaggaatttgataaccaaaccattcatgagattctgaatggtttggttatcaaattcttttccacgatccgtatggaagagttcgatttcttgaagtgagtaaggaatgctttgaatggccctttttacaagctgcgcatcttttttatttccgcaagaatggccaataatttcacgattgaataaatcaatcatcaaacaaatataagcccaatttgtcccgacccgaacataagttaaatccgtgacaaccgctgacaatgcttttgtttgagtaaactttcgatctaagtgattcgcaattttcttttgattgctttggcacgatcataaagacgggagcagatattgtctattgatataatgatagtagacaaacagagttggctgattagctaaagcatatcgagtataatttgaatattagacgcatgatttatcagtgtaagaaagggtgaggattatgaaaaggtttttgaaaatatttatctttctcgaaataatactttttgtatatatttttaatacttctatttacaatatttatgaaaagaataatattgcgactgataatttaaaaggatatgttttagaggaaacatcgccggaaattcttgataaattttatacgatatttacagaagaatattcccaaaataaattagagcttatcaataataaacttacttctacggataaatctgtctatgatttatattgttatccgctaaatgaatttgtgcaaaaacagcctatatcaaattctattctgttgcagtatcataaattgcaaaaggaagattttttggatagtgtcggggtattctatacggatttgcaagccaatgaaatacgtgaaatagaatctcaactggctgtaacaattagtgtttttgaaaatgaagctatcccgtatagtatgatattagagttgtatcttcttaattttgtaattttgtttgttgtacttcaaataatatattgtatttatacatctgatagtttgaaaaaaaaaggtattaaaaaaagtatgggcttttctgctatgcatattttaaaggagcaaatcaacaatatagtaaaatattttattgtgatatgttcggtgttatttatcctgctgaatttgtattacgcattaacaaatcgttttaatatttcttatttaacaataagtatatttttctttgcgattattttggttataaacatactttgcgttttaattaccagctttttaattaagtttgtttctttggaggcaatgattaaaaataagactttaaatagcggtacaaatcttatagttcagactataaaaatagttttttcagtaataatcacaattaccactatttcattattgaatcaaggaaatgaatttaaacaaagccaacaggatattttagattataaatatctggacggatattttacggctaatggttttaattctttagaatatgaatatgcattagaaaatccagaacaatttgaagaatattctaattcgatgttagaactgtataataatcatcatgccttgttatgtgattatgctggtagcagtgaagcacaaggggaatttagtaaatctcgtccatattatatacagcaaacaataattgcaaatagaaactatattagtgagttttcaaatatccaagttaatggaaaatcattaaatgaggatatatatgatacgccaacaatattagtttcccgtaaatataaaagtgatgaaacttttattaaagagcatataactcaagagtattttcgactgatgaactacaatcaattttatgggatacctgagaaggaaaggcatatcaacgaatttaatattgtgtatgtcgatgataattctactataaaagttaatacagaaaatggcttttcagatatgtcagaacctattatcattattgatacaggcaattttgcaggtctttactatttggattctttaaatacaagaaatttatttttccaaatggattcaagagaagaattttcttctttattagcagagtatggtttaaaacaattagttacggcaggaacattacttacaccatacttaatgcaactggaaaatgtgacctttgtccttaaaacactcacaatgtttgcgattgtctttataatatcattactgtttatcttgtatatttcaaattatgtagatatttttgtgaatcgaaaaaaatatgcaactaaagagattatgggattctctcattttaaaacattaaaaaatcgttatatattttggggaatagagttgattgcatcatgtatattgactgctataaattacaactttgcttgtctttttgcaattatacttattgactatatattctgtgaattactttatagaatttatatcttaaacgctttgtatgaaatagaaaagggggcataagtatgtcattgattacattaaagaacataaaaaaagtatatggtaaaaatcaaattttattcgagaatttgtcgttagaaatagaaaagggtgaatttgttggtcttgtaggtaaaagtggtgcaggtaagacaactcttttaaatataattggattgattacagacatatcagagggaataattactattgacggtcaacaaaaattatcagtaaacagtagaaatgcaatgcttttaagacgatatacgataggctatctatttcaaaactatggacttatagaagatgaaagcgtattatggaatttaaaattagctcttgaatataaaaaaatgaaaaaggaagataaactgaaagtaatcaacgaatatttaaaacaatttaatttgagcgatatgctcaataaaaaaatatatcagttaagcggtggagagcaacagcggattgcaattatcaaattaattttacaaggaagtcaaattatactagccgatgaaccaacttctggacttgataaagaaaatgaacaggtagtgatgaaacttctgaaagaattgaatgaaaagggcattactataattatggtaactcataacatggatttgcgtaactatttttccagagttataaatgtagaaacttttagatagtttattaaagggagatatacttttttgtgcaatctcccttgttctttttctgtcatatcaagactcgttcaataatggtaaattcgtggtaaaatagctacttttttagttgatgaatagcccttaaatactgtatttatgcggataatcggattttttataccaagtttggatatatcaacaaatcatttgataattatgatcttggttttataattaatttaaaaaaataaaaactatcgatgacttactcacaaataatttagttctcaaaaaagcgtactgtgatacattctaatgacgagagcgtctttaccggaaaaatcaatcttttagattcaaaaaaactagtactttctataatagattacgaaagcatcacaaagacgaacaaaaaaaacaataaatatagatgcagactgtagacatcatccataaaatggactttgtctacagtctgaaacgagatctttcttcttacgtgaaggaagaatatccagtaatttcccagtatcgccatccatacaagaaaaagaatagggaccgacttgatttttcaatgaacgaaattcatccaccaatgaacagcgaggcaaccaattccttttcacgtttgtcatggggagcagagaagcgagtgttcgcgaaacggttgaccaagaaacgccgcaatgtttagaaatcgtcgtcattgcttgtttttcagtcaattcctccaatattttataatgtacttgtttggcgataaaacagtttttttcaacaatgtaggtattcgccgtaaaataggtgtgacagccacgacagaggtaccgttgctttgccaaagcaagataagtccgttgattcgcacacttattgagaaggaccagcgattttttctttccgctcttaacgatcagcccatgttgcttcacctgtttacactgaggacagcgctgaatcgttttaatgagcgtggcagaaacaacgatactgttgattgaatgtatttttttcttctcgacatgagtgatttgaatgtttttatctttgattcctagtaatagtttgataagatgaagatcaggcatacagaacgctcctttgattgtgttgtggtgtaagcgccccatagaacagtaccttactaacaaatgcacctcaagatatacttgagctatcaagaagtctggaggttttctatgtataaattaaatgagattgttcctgtccaattaggaaacgaaaagagtgcaccagaaaaaggtaaacccgcggctgccaagttagcgatgcgcatcaaaagagagaatggttctgaagttttgatctataacggtattaacaattatattcttcaagctattttgaaagaactgttgtccaatgctttatgatttacttcaaaccaaacatatttatattgtgtgcggaaaaacagatttgcgaaaaggaattgatggtcttgccagtcttattcaacaagagtatcaactcgagctttacgaagatgccgtttttttattttgcgggaaccgtcaagaccgtttcaaacttctctattgggacggtgatggttttcttctctgttataagcggatagaaaacggcaagttaaaatggcctcggacgaaagacgaagttcgaaccttaacgaaccaacaggttcgatggttgttagaaggattaagtatcgatcaacctcgagctattttgccaggaaaaaaaggagtttttcaagctggggggttaacacaaaaaatgtgttgaacccctatttcttgtgcgtttcttgtggtattctgtaacaaaatcagttcgattcaaggtggtgaaaaattttggaaactacagatacgttgcttcagttgcttcaagaagcccataaaaccaatcaagcacaacaacaaaccattcagaatcttacaactgaaatccaactattgaatgaaaaggtcaattatttaaccaacaaattatttggacgctctaaagagactctctttgaggaaacgaatgggcaattgaatctttttagtgatgaagaaatttctgtaagtgttccagaagcagctgccaccattattccagtaaaaggacatcaacgagttgtaggaacgaaagcagacaaaatcaaacacttacctataacagagaaagaacatctccttcctttggaagaacaattttgtgaacattgcggttcacagatgaaagatatcggacggacaaaagtacgagaagaaattcgtttccatcaggctatgttggattgtctcacccattatcaacatacctattgttgtaaaagctgcgaaaaagaaggactttcttcttttaaaaaagcgatcgttcctaaacctttgatttctaatagcttaggttccaatagtttagtggcggaaacgatccggatgaaatttggtcagaaagttcctgcctatcggcaagagaactattggaaacaaacacatgggttggatatttcgagagataatatcaccaattggcatattaaagcagtgcaaaacgcgttagaccctttaggagaacgattaagagtctatcttaatcaagaagagattctacacggggatgaaacaagttatcgtgtgattgaaagtgccaaaacagatacctattactggcagttttgtacaggaaaagacagtcagcatcccatcgtttattatcaccacgacgaaagtcgtgctggagatgttccgaaaacttttctcaaggagtttacagggtatttacactgtgacggctatagcgggtataatgccgtggaaagtgtacgacttgtctattgtttcgcgcatgttcggcggaaatttttcgaagcaattccaaaaggaaagaaaaacacggatattcccgcagctcaagcagtcaaacaattggataaatggtttgtcctagaaaagaaatggaaagacttttctcctgagaagcgattaagctgtcggcaacaagaactgcgtccattatttattgctttttatgagtggatggcaacgatagatcctgttgcaaaatccaagttggatgcagccgttcaatatgcgtgtaaactacgaagtggttttgaacctatttttgaagatggtcgtttagaactcacaaataatcgtgcggagcgaaatatcaaagagctggtgataggacggaaaaattggttgcattccacaagtcttgaaggagcacgaacttcaggaatcattctgagtgtatataaaacagcagaacttaacggattgaatcctgtaaagtatctagagtttctatttgataagataccaaatcttcccgtactttcagcagaaactttagatcaactgttgccttggaacaaggatgtacaacaacatttttctcgtaactaaaaacgccaaacattcccgattctattctataggtcgggttatttgggctctttgtcaataaggactgatgggttgtacaaaatcaaatctgggtcagaatgaacctcattctggctcagattttttgttatcttactttgattaattgattgatcaaaaagattctaattctcatgttctcaaatgatttaaatccgtaggatactcgtttcattgtctttatatgggtattcttcgcttctatttttccattggtgtaaggatagatcatcgcgttggtgatgccttcttcataggtcagaaggttttggagcttttcccgaaagccgtcatctaacgtttcgggaagttctgccaataaggagaaaaataagtcagggtctttgtctcgaaaggcttcaactaattcatgaaaatagggatacgcctccttcagggacgtagaaaagccaagcaatcgatcaatcatcatcgcttccgtaagaaatgggtattttggtgctcgaaaacttttccatgttttgtattcataatagttgatgtttgcacgattttttagcaaaaagcgccagttctttttcagtttttctgcctgacttttctgtcctactttacgaagttcattcatttcacggatacgcaactcattaaaggcttgattcatgtgtttgataatatgaaaccgatcaatcactactttcgcatttggcagaatacgtttggtaagctggaagtaggcggcgttcatgtctgtgactaaaaattttacttctttaggattagtgcagcctaagaaatagcttgttaatcgaggcaatttacgcgtaggcaagacatcaattaattgtcctgtttcgccatctgcgcaaataaagctcattttatcttctatggaagcgtgcgaacgaaattcatcaaccatcaatactctggggagaatcctcttagattgctttggtaagtagcttttaaactctttcaacgtacgaataacggtggtcaaagatacctgacaatttttcgcaataaaagataaagatactttttcagtcagtaaagaagcaattttatatctgacatgattcgcgattgaatgtctgggttgaacaaaataactttgagccgtccaatgggttcgacagtttttacaggtatagcgctgcttttttaagcgcataaccaaaggcatgtgattgtattgttcaaagcggacaatcgtttccttcttcccatttttcactacaattactttcccgtttccatctaccacagtagaaccacaatttctacaggtatggggagcaggtgagaaaacagcatcgacgatcaacgtctttttcttctgaaaggtctcgtaagagacctctgtaatcatcaaatctttctctattaatcgcagcatttttttgatagaatcattcatatagcatatcgtcctctcagttgcttattttgtcgtgatttaatcatactagagaacgatatgtttttaatacctaaaataaaaatggggctgaagaatcaattctgattcatcagtcccataaattatagagccgttatttgacgtacaggtactgttctatggggcgcttacgatcaagaggtgattacacgatggctagaaagaaaagaaatcctgatgctgagaagttagctgaatccattttgaatacttatcaacccgaatctgtagaggatatgcaagatgttttaaaagatgtgtttggtcccttatttgaaaaaatgcttcaaggagaattgaataaccatttagggtatgacgcccattctaaagagccaaagaaacatgacaatcgacgaaacggttatggcaataagacgcttaaaacgagctttggtaaagtaaacattgatgttcccagagaccgggaggcttcttttgaacctgagttgattcctaatagaaaacgagatgtctccgacatcgaaggtaaggttctttccatgtatgcacgaggaatgagtcaatgcgatatcgccgcaaccgttgaagatatttacggctttgatatttcccacgaaatgatttctgatatcacggatgccgtccttcctgaattggaagaatggcaagctcggccattagccaagtgttatgcatttctattcgttgattgtatgtacgtcactttacgcgaaaactatgaagctaaagaatatgctgtacacaccattcttggctatgatctcaaaggaaataaggagattttaggattatggttaaatcaaacagaatctaaaaatcgctggatgcaagtatttgatgaactgaaagcacgtggtgtcgaagatgtctttttcatttcgatggacggtgtttctggcctcgaagaaggcgcaaaagcgatctttccatcggtaattgttcagcgctgtattgttcatcttgttcgaaatgcattgtgctatattccaagtaaggactataaggaagtctgccgagatatgaaaaagttctacggtgcttcttctctaaacgctgcacatgctgcttttgacagttttcaaaatcggtggtctcattattctggtgctgtagatgtctggaaacggaactttgcacatgttgaacaactatttgattatggtagtgccattcgaaaaattatgtacactaccaatgcggttgaaagtgtccactccagcttcagaaaagtcacaaaaaaaggagcgttctctaatgagaatgcactcctaaaactactttatttacgcacgaaagaattacacgcgaagtggtcaggtggtcgaattcaaaactgggctatggtgcttaatcagttaatgatcaacgagaccttctcctctagaatgaaaagtatgcgatttaccttccgtaacaacggtaggtttattcaactatgtgtccgatcaaaatttatctgatttcaaaatagccgagagaattatggtggttaaaaactcttaactatttaacttccacagtttagttgacaaacccacttaattctgataacgaaaaacatattcgaatgattaaacagaagtaaatacttatttaatggtaagtagtcatttgatagtttgaggcaaattgttgattgatgaagggtaggagctaaaaaaagataccagttgaagagagaaaaagaaaaaaatagagggtgttcttgaatgaaaaaagttggaaaattatttttcatttccttttattcctattaaagtcagtgatgtcaatcatattaacaagactaaaaatgaaaataaaaaaaagattgttcttagtattgactcataaaaaataccactactatacttacattgtggttatagccagttaggagagacatcgatgcaaaatacctttcaatcaaaatcactttattatcagctggtagaaatattgaaacaacgaatcgaaaacagtatggtcgctcatgacaagctgccatcagaaagagagttgaccagtttttatggcgttagtcgcacgacggtgcgactagcattgcaagaactggaaaaaatgggctacatttatcgacaacatggaaaaggaacctttgtttcggaattaaggacaaatgcgactgatctagctggcgcatatagttttaccgaacaaatgcgggcaatgggcaaacatcctgaaaccaagatattggccttcaagaagattgaagcaactaaatatttagcgagtcatctgaatgttcaactaggtgagcctttatttcaattagaccgattgcgcttagctgatgatttgccaatgatgatcgagaaatcctatttgccagtgaagctatttatgtccctttctcaagaaattctatttctgaaacctttatataatttgttttcagagaatttcaatcaaatcgtacggttggctgacgaggaattttatgccagcattgtccagaaagaagatagtgagttgctaaatattccagaaggatcaccagtgctccatttagttcgctcaacctataatctcgagaacgaagtgattgaatttacattaagtgtagcgcgggctgataaatttcattataagatcaggcatctgcgttccactaactgaattggaggaaagaaaatgtttatgttctcaaaagaagaactacgaaagctaggagcagaaaatactacccgagaaattcgacaacaaccggaactgtggcatgagacgtttgaccgttatcaagaaacagttgcagatttagatcgtttgtttacggatgcgaaacaacatgctggagagcgaccaatccgagtcatttttacaggggccggaacctcgcaatatgtgggagatacactaattccgtttcttactagtcaaggaaatacgaaccagtttatttttcaaagtattggttcgaccgatatcgttgctacgccaaaagaatacctgattcctgatgagacaacgatcttggtctcatttgcccgtagtggaaatagtccagaaagtctagccgcagttaagatggccaatcagctggtcaacaagatctatcatatcgtgatcacctgtgcaccagacggattattggctacacaaatgcctacaaaaaaagaaaatctagttttactaatgccaaacaaagccaatgacgctggttttgctatgacaagcagtttcagctgtatgacgctgactgcgctacttatttttgatcaagcaagcaatcagcaaaaagaaagatatgttcatcaattaagccgactaggagaagaagtcatccaacgagaatcagagatccaagggtatctggcatcagactttcatcgcatcatttacttaggttcgggaagtttaggcggattgactagagaagcgcaattaaaagttctcgagttaactgctggaaaaatcgcaaccgtatttgatacatctttaggattcagacatggtcccaaatcttttgtcaatgagcaaacattggttttcctgtttgtcagcaatgactcatatacgcagaaatacgatgtagacatgctggaagaaatcaaaaatgacggtattgcccaacgcgttgttggaattggtcaaaagggttcattgtttagtggtgattcctttgaattagttgcagattcgttactgccggatggctatcttgctttagcagatatcatggtagcccaaacgatcgcattactttgttcggtgaaggttggtaatacaccagatacaccatcgccaagtggaacagtcaatcgtgtggtcaaaggcgtaacgatttatccatatgaaaaataggaaagagtgtgaagcatgttagaatggtcggaaaataaaagacaagcaatggaacgtctatcgacgccagaaggcattattaccgctttggcgatcgatcagcgaggcgcgctgaagaaaatgatgtcggctttagggatggaagcgacaaaggaaaaaattgagcagtttaaaacactaatttcccaagaattgactccttatgcctcagcaattttattggatcctgaatacggactgcctgctgcacagaagcgtgcagcagcgagcggtctgctgttggcatatgaaaaaactggttatgatcaaaccgtacccggccgcttgccggatctgctgtcggactgttcagttctgcgattgaaagagttaggtgcggatgcggtgaaatttttactgtattacgattatgaagaagcagaggaaatcaatcggcaaaagcaagtttttgttgaacgaattggaagcgaatgcatggctgaaggactgccattttatttagagttattgtcatatgatgctaaaaatgtagatacgaaatcgctttcctatgccaaagcaaaaccgcgcaaagtgatcgaaatgatgaaagaattctcgaaaacccagtataaagtagatgtcttaaaggttgaagtaccagtaaacatgtcatttgttgaaggaaatgcaacaggggagatcgcctatacacgtcaagaagctgccgcttattttaaagaacaaagcgatgcaacagatttgccgtatatcttcttaagtgctggggtatcagcggcattattcatggagacattgcgttttgccaaacatgctggggcacgattcaacggtgtactctgtggcagagcaacttggaaagatgcagtcgctccttttgttgaaaaaggagaagcggcaactttagaatggctgacagaacaagggacacaaaacattcgtcaattgaatgaagtgataagagaaactgccatcccatggtatgagaaagtaagtgaaagcacttgttaatgtttctaatatattagtagtgataagagatatgtgtgattataatttatcattattgaaactgggaggatattttatatgaataaaagattgttagattattcagcttcagattttttgaaagctaagccgatggaattaaagcaggcaattttggcttctgaaggtagaacaattatggcagaaaatgtgccaagtagctgtccttacatgggaaaatcagtgacaaatgcagaattggagagagctgctggagctgatttaattttgtttaatgcactagatctttttaatcctcaaatttcaggtgtacctttaactctaaaagagaatccaataatctggattaaaaaagctttaggaagagctattggtgtaaatttagaacctgtagacaaagaagttttgatgagtgaaaatcgaactgaaatttcaagtggtagaatcgtttctcctgagactttaaaaaaggcaaatgaattaggctttaattttatttgtttaactggaaatccaggaacaggagtatctaatagaactattgagaaagcaataacattatccaaatcaatttttaatggattaattatcgctggaaaaatgcatggtgctggtgttgatgaaccaattatgaacttagatatagcaaaaagatttattaaaacaggtgtagatattttattagttcctgctccatacactgttccgtatttcatggaaagtgatttgcgaggaatcgttgattatataaaagattttaatagaaataaatctattgaggaaaaagttctagtactaacggctaatggaacaagccaagactcttctgaccaagaaactattaaaaaaattgcattagcatcaaaagcatgtggagctgatattcaacacataggggattctttaaatggtatttgtcttccagaaaatatttttgctttgggtcaagcaattcggggatatcgtcatcaaattattatgttaggaaaatctaattatcgttaattaaggaggaaatgaaagatgatcgacaaagttcaaaaaatagctgcaaaaattagtaatcaaagacatctactagctttaagagacagcatggctgcagttatgccattaatcattattggttccttttttatgttattagcaaatttcccgatagaaggatttacaaaatggttatctgaaattggagtacaatcctttttgaacaaagcatcagattcaacatttggtattattggattagctgttacctactctttgggacacaatctagcaaagacttatggtgtagactcattatcagcaggattattatctttgagtggatatgttttacttacacctttattggatgcagatggttctataggatttccaacaaaatactttggtacctcgggtctttttgttggtattattgtagcacttgtatctacagaaattttccggtggtttgtacttaaaaatattacaattaaaatgccggcaagcgttccaccaaatgtaagccgagctttcgttgctattattcctggcttttttgtcgttctactatggtttattgttgttgtaatttgttataaacttggaattgaaaatgttcatgctcttattgcagatacactcgcaaaaccactatctttactgacgaaaactttaccaggaattatattggttatacttattcaatgtttcttttggatgtttggtattcatggtgcacaggtaacggggccaataattgaaccgttattattgcaaaactctgatgcaaatagaattgcttatcaagctggaaaagaacttcctaacattataacttatgaattcttatataactttgttttttctggtggtgcaggttgtttatttgcacttgccattttaacatttttcttttcaaagagtcaggaaaataaaactttaggtaagttatcaatcgctccagtaagttttcaagtagcagagccccttctatttgggtttccaactatattaaatataaaaatgttaattccatttgtaactgcaccagtagtaacaacattaattacttatttttcaatgagtatgggattagttgcaaaacctgtaggagcaacaatcccatggacaactccaccgataattgccggatttttagcttctggtggacgaataagtggtgcagtgattcaagtaataacaattgcaataaatgttttgatatactatccattctttaaattagatgataatgccaagctaaaaagcgaaaaaaatgattagaactacctatatgtttctaactgtagttaagtatgaaaagactatttttaaatttagcatttttgcgctatcggcgtagatgaagtatcacgataacgaaattagtttctttcatttagaatcgccgtttgtataattaagcgagacaaataaaaaagccatttatgttacactcaaattgtaatacccgctaaagcatacaaggagagtgaacataaatgacttatacccatcttacaccaaacgagcttgtaatgatagaagcatattttcatcaagaaactccggttgctatcgttgcgaagcagcttaaacgtggacgccaaacaatttacaatgtctataactctctcaaatgtggtggaacagcacttgaatactttgaacaatacaaagaaaataagcgacgttgtgggagaaccgaaatcatttttcctgctgaggaaaaagaatacattgcaaaaagatcaactgaaggttggaccccagacgtcattattggccgtgcagagcgaaccttctcttgttcagtaagtaccctctatcgccggtttaagacgggagaattcaatgttttacatttaccgatgcaaggaaaacgaaaaccaaatggttataaggaaaaacgtggaaaacaggcattcaaaagaaatatttctgaacgtaaaaaagattatgtcgttttcgaagaagaatttggacatttagagggtgatacgattgtcggcatccaccataaaagtgccgtcatcacactcgttgagcgactttcaaaagccattatcgccttgaaaccagaaggccgtaaggcagttgatattgaaaattcgattaatgaatggcttcaatccgtacccaaaaatcttttcaaatcaattacctttgattgtggaaaagaattctctaattggaaaagtattagtaatacgaatgatattgatatttatttcgcagacccaggaacgccttcccaacggggattaaatgaacattcaaacggactcctccgaaaagatggactaccaaaagaaatggacttcaaccaagtcaatcaaggattcatctcatccgttgcgtccaaaagaaaccatatccctagaaaatcactaaattaccaaacaccattagaagtttttttgagttacgtaaatggaaagttttgtctcgcttaatttgacaaataataaatataaaaatgataatgaagcttgcctttaaagttgggcttttatggctctttgtcaagtgatgttggtaaagagaaatcttagaataatttggacagaacagaaagaagaaaggctctttgtcaataaggactgatgggttgtacaaaatcaaatctgggtcagaatgaacctcattctggctcagattttttgttatcttactttgattaattgattgatcaaaaagattctaattctcatgttctcaaatgatttaaatccgtaggatactcgtttcattgtctttatatgggtattcttcgcttctatttttccattggtgtaaggatagatcatcgcgttggtgatgccttcttcataggtcagaaggttttggagcttttcccgaaagccgtcatctaacgtttcgggaagttctgccaataaggagaaaaataagtcagggtctttgtctcgaaaggcttcaactaattcatgaaaatagggatacgcctccttcagggacgtagaaaagccaagcaatcgatcaatcatcatcgcttccgtaagaaatgggtattttggtgctcgaaaacttttccatgttttgtattcataatggttgatgtttgcacgattttttatcaaaaagcgccagttctttttcagtttttctgcctgacttttctgtcctactttacgaagttcattcatttcacggatacgcaactcattaaaggcttgattcatgtgtttgataatatgaaaccgatcaatcactactttcgcatttggcagaatacgtttggtaagctggaagtaggcggcgttcatgtctgtgactaaaaattttacttcttcaggattagcgcagcctaagaaatagcttgttaatcgaggcaatttacgcgtaggcaagacatcaattaattgtcctgtttcgccatctgcgcaaataaagctcattttatcttctatggaagcgtgcgaacgaaattcatcaaccatcaatactctggggagaatcctcttagattgctttggtaagtagcttttaaactctttcaacgtacgaataacggtggtcaaagatacctgacaatttttcgcaataaaagataaagatactttttcagtcagtaaagaagcaattttatatctgacatgattcgcgattgaatgtctgggttgaacaaaataactttgagccgtccaatgggttcgacagtttttacaggtatagcgctgcttttttaagcgcataaccaaaggcatgtgattgtattgttcaaagcggacaatcgtttccttcttcccatttttcactacaattactttcccgtttccatctaccacagtagaaccacaatttctacaggtatggggagcaggtgagaaaacagcatcgacgatcaacgtctttttcttctgaaaggtctcgtaagagacctctgtaatcatcaaatctttctctattaatcgcagcatttttttgatagaatcattcatatagcatatcgtcctctcagttgtttattttgtcgtgatttaatcatactagagaacgatatgttttttaatacctaaaataaaaatggggctgaagaatcaattctgattcatcagtcccataaattatagagccagaagaaaacctctttctgttctgtttatttggttaaaaatgttttgccatgacgaatcataattcgtagtttgaaattgtaaaagttgcgaaagccgtacgcattgcgttttaatactttgatgtggttgtttaagcattccaatggtccgtttgaatagctgtagtgaagcgcattttggatctgtggcagaaactttttaaacgttcgtaaagtggttgtataggtttctggcagaccgctaatgtctctagttaaacaatcctcaaatagtgactgatctcttttctttaccgcataaagaatgtcttggtataactgatagccttggcgtaagttgggacaagcagctaacagtcgatcggcaatctcactttcagtcaaataatctttaaaaactggcacgccaaacccgtttttcatagtttaacttgctttcttctttttgtaggagtttccaatagcgcttcaattttttccctaaccctcgttgagagtgggaatttcctttaagtcgtaccgtggtttctttcactcgatgattcaagaaagttctgccaatatgttggacgatgtggaaacgatcgatgatcaactgagcattcgggaaaagctttttcaccaacgaaacataaggcgcatacatatcaataacaatcaattgaacggcttcacgagtcgctaatgaaaaccgagaaaaatagcgttctaaataaggcaagcgtcgattttcgacaatatccaataatgcatggctttgtccgtccatcatgataaaactcattgcactggcaacacttcgaaccgatttgaattcatcaaagcataagacctttggcaaagtctgtttgaaaggattcaatgggcggtagaatcgcttcatgacacgatagaccgaagaagtggaaatatttttctgacgagcgatttccgtcatggaagtattctcttttaagcgagcaatgacagaccaacgaactttttgactaatgaaacagtgtttttcagcaacagaggtatccgctacgaatgttctttggcaagacttacatttaaatcgttgtttcttcagctccagataagtgcgatactcagacacatcattcagtaacaaccgaacggttgtcgtcccccaacgaatgatcctagaggggacgacacaaagacaatgggaacactcttctggcttgtacagaagagttcctttgtaaatcaagcaaatttgccctttgtatttttctttagttaaacaattttcctcgaaatagatatttaggtctagaatatttagggtatctttgataagctgagtatgagacatcttgaatcctcctatgaattggtagccaaattaattctaaaggatttcagggtgtcttttctatatttttttatacaaaaaagatgttggtgaagttcaccaacatcaaaaagtatagagccgcttttatctaattttagagacaggcttcattattatactattttttactacatttacaaagcgttcaaagcatcaattgtagctgcattgtctatatgagtatataaagttgttgtatttgtacttgtatgtcccaattgttgggcagttaataccaatgaatttgtctgttgatagagtctagtagccaaagtatgacgtaatttatgtggactgacttggactctgaatccttttgaatattttgctaccatccgttcgattgcaataccggatatacgcttggcttctccttgataaattgctagaaataaagctttttcgttttctgttactttgtatcgttctttccgaatagctagataattagctaaatattccattgcaaatgctgctatatttactgcgtctctcttatttccttttctagttactaccacattattcttttctaaagataggtcctctaaattaatatttacaacctcggagagtcttaatccagatcctaaaatcaatgcattgatcgccaggtctctttctacatctcgttgataatagatcaaagctcgtttgctcaaagtttttttatattcattggcaatataatctagataattttgtgtaccttcgtctagaaataattttttctcgattgcgtttgcacgggcagctaacgtagttttatctgtgatagttgctacttgatccataggattattttctaagtatggttttcctaaaggattattggaacttttcgaaagatatttaaatagaacctttaatgctgtgatatttctattgatagtagaagtagatagacctaagttattattatctttgagcttagtttttgttgtctctttttttacattttcctttgtgcgacgtttcaaatgagatttgtacaagtttagatcataggcagttaactgtcttatcgaggtgattgaagtatcgggaacgatagactcactcagaagccattcataaaagagcttataattttttagatattctaaagtagttcgaggtgattgatctttatcctcacgatcttgaacaaaatcttttatataatcgggcatatgaagtatgattgtatctattttttgatatatttctgtatttttcatgttattcatcctttcgataagtaggggagaggagtatctctataattggactataccaattacagagtgttttgtcaattggtatactctgaaatttattaatttatttcaaaaaagcagataaataggtatagatttaataatttaaaataaatggtatacatgaataggaaaggaaacagaaggaggcaatcttaattttttaaattgtctaaattatatagaaagaacaatctttctatataattagacataagagagactacggttgatttgatattaacaagcgtatatgaatgtatatacaaataaaaaggggagggagaagttaaagaaaattcagagaagtggggcactcagtagtattaacaatttaaaaggaatttcttaaagaaaatgggttgcatcctggagatacaatttttttagataaagaaaaaattcaagcaacaattcaaaaaaatcttaactgctgagattgatgtagcaatatctcaatcatcaacaaagtacgatcctgcctttcaaaagcttattgataaatgtttattcattataacccgtggtgctagttaattttttcttagaggaaaatgtctaaacatgttggtaaatcaacaaaaaaacgcatatagtagtctcaaaactcccaagaaatgaggactacatatgcgttcatcaaaatatactgaacattatacagatacttttataacattcaaggaaattatgagaactgtttctaacatataccacaattgtgtaccagataagattaaaaaccgaagaaatactgatcaactgaagcaacgcgatacagtgattattgcttgtgttatatggggcataattaatggctatactagccaaagagccacgtatagagcggtttgttccgtcttatttcctaatggtgactttcctagtaggagtcgattcactcgcttaagttcaaacttagcttacactatcaagattattcgatactttttcatcaagaagctcaccaaaggtgaactagtcggaattatagatagttttcctagtccattatgtaaaccagttagaaatagacaagcaaaactattgaatcaaatagccaaagttggctataactcaacaaaaaaatcttatttttatggtcttaaaattcatatgatcgttactaagactggctttccgattacttactcaatcacgaatccaggtgtccatgacgtgaaagtgttagagactttatcggaagaagcgaatcttcccaatatcctaggggacaaaggatatattagccataaaatccatgaaaagcttgcccttaagggcattactatatccgttccgccacgtaaaaacatggataaatcagaaaaactagaccacagcttacttggaaaacaaagaaaaacagttgagactgttttttcttccttagaaaaattaggttgtcaaaatttcaactcacgttctgttaaagggctagagagtagatttgaaagcatattactggcttacagtgttctattaagtcgagcacaacgacgttttgaaggaactttgagatattctttaggatattaaaattaactagcaccacgggttcattataaaaataaaagaaaaatttatgtcagcttttttcatcaaagtggtaatgataattcgtctattaattgtattttttaggaaatatggtataattgttttaacgaaaaggtaattcatgatacaccaaaaaccactagctggcgggctagtggttttcttttacgctctattcagattaacgggtaggcttactgtcttttttggcaataattttgcaatcaagccatttacagatgtaatgcgcggatacttctgctaagattgcaaaaaacatatcgaaaaggtaattcataatacaacctcctccccttgccataataggccggggtagcagacagcataaatattataccataactgaaaatttcattttagtacatttcaatatattgatgaaccagcacaataaaacatgccatgactaacagaaaaaaacttattaaaccagatataacttgtaaacatccaactatatagaaaacgtaaattttctatatagttggattaagataacgactatttattttatcatatttttactataccctatacttttacttggtatatttatgaataatcgcaaatttacccctatactactagtttgtaagttagattaataaaaatactaaagttatttgttcttttattaaatacacctacaacttataaattgatggtatttagataacgcgaaagaataaaaataacagctgatagtaaagtttgttgacgattgctactcaatcgaaagtgagttagtgcgtatgaacttgcttctgaaaacttatgaaatgaaagaccttttacatcttgcagaaatcgttactgggattaaactaagcaataaaaactaatgttcccctcattctttgaacttttactatttgatttatttattctgataaatgacgatttcaccttcaggatcttcaaatcccgtatagaatttatttaataaatagctcataaaactggaaatactaatttggggtgatactatcaccaacagttacttactcttaattttccataaatcacttttcatcgatactccggggtaaagactatgggatacttacaattccatcttgtatgtgctaaacttttatcgtcgttagacataaaaaactgaatcagaatgaacttactctgactcagatctgattttatcccaaacaaagtagtatgtttgttaccatccgaatatttgatttttttgaaataaataaagacgcaaagttttgcctgtatctgagtatattttgactcagtataccctatgttgattttttattgcatcttcacttttagtttattttttactttttaaagttgaaacgatatttgaaattcctatttgaattaactgtccgtttttgacaaacccctcttctctaccttttaaatatcctactaatttatgtttcatttcataaataatagattcgtattttttatcataatataggtttttcatctcatttggatcatttatcatatcaaataattgatacgtattttttacgggaaaccatataaatttccatttctccgttaatatatattgactagaatccagccctaaactatgttctccatgaatttctcgccgccatccttcacagtttccaaagagcaactgtttaacactttttccatctgtatttacatattgtcctaatactaaatcaactaatgaaggaaatatatcctgtatttttacaagctctttaattccatgtttttttgctgagatcagatcaccaggatcgtaaataaacgacgggatacgaatactcccttggtaaggatacccttttctgaataagtaatgttctcctaattgatctccatgatctgaaatgaaccaaatgattgtatctttatcatgtctaaattcttttaaagccattaaaaagcgattgatctgatgatctatatgagaaataaggccatagtatccagcaagcattcttctttgatcatcctcttttaatcttcctcttaaggcacaaacatctggaacaacatgttctaatttctcccaattaccaatatgcaaatctagagtgtctggtaatctatccatatacatatcaaaataatattttggtggattcaaaggagcatgaggtttctcaaatgataattttaagaaaaatggtactgtaggatctttccgccttaaaaagtttattccttctgaaaccacccaatttgttggatgaaatttttcaggatacatccatggtcgtgcttcccatgaattacaatttaacccatcatcaatcaaatctgcatctgagcccaatgattcttttagaaacattaagtaatcactagaatattcaaactgctctccataagatttgtcatattttcgatcaacatgaagatacccgtcatgcaatagtacatgatcaaatcccaaccgttttcttgaaggatacacatgcattttcccaatacactcagtttgatatccctgttctttaaaaacttctggaagagtatttttaaaattccatggaacctcatcttcataacccactcttcccgaagtttcttgatctaatcctgttaataacgctgctcttgctggaacacaacttggaacaggcgaataacaattctcaaaattatatccttgactagccatcatatctaatgtaggcgtactaatgattttatcttggctattcaaagataacgcatctgctctcatctgatctactacaattaaaacaacattgggttgattctttttcatattaaaaactccaatcattcaaaatatccaaataacctctcttgatttaagaaattgatatttccttttgaaagaatatattttttgtgataacaagaaatataaatggattaccaaactttatagcgtatgattgattagtcacgaatactttatactaaaataaaccttgatatcaaaatatctttaattttttatctatataacttattattcattaaatctctaatatcttctttccactcatttaaaaatataatatttagaaaattaaacaggggacatgccataaattagttgatcacgcccccacatctattacaaaactgctaaaatatttaatgaatacattagtattgacaaaactaaaaatatccaaataactttggttgaattgagagattttttgcttaataaccaatatgccaataaaactaaaacaacaggtactatagctggcataatagggtctaacatttctgtttggaaagatagtttcttatcaccaataactaacttgaatggaacaccaacctttacaacactaggaaccaagcctcctattactactacgccaagtaaagttgctgattcagttaaatccttcaacaatccacctacactggataccagttttttaccttctcggaaagcaattggtaactcaaaatatctcaaaaatagtataatgagagatactaataaccaaagtagtacacctaatggatttccttctaatcccatataagctgctagagatccaaaaattgttggaatcactgccccaaataaagaatcgcctacagctgcaaaaggtcccatcatactcgttttaattgctgcaacagcatctttcgatttgcttccatcttctacttgcaatgctaaatcaattccaataataaatgcacttaaaaaaggactggtattatagaattgcatttctgattgcaacacactttttaattctttttcatctttgtataactttttcaaagctggatatacagctcgaacatatgccacattcatcattcgttcgtagttccaacctagttgagctccaaacatatatcttaaactaacttttctcagatctttgctacttaatttgctaacattagatttcatcatcatcaacctctccgttaactacttctatatgattgatagtatctagttttgattctaataaacgtttatcttgtaattttttatagtgaataatagcagctgccaatcctgcaaaagaaatacccatcattggaatatttaaataagcggctaaaatatacccaataattaaaaaaccgaaaaaattcctaattggcaaataatgtagtaaaatggcaatcccaacaactggtaatatagctcctgccaattttaatcctcccattaaccaatccggtgcataatttaatactgtatttactacttcattaccaaaaattaaacataaacctactggtattgcacgagataatgcaataggaactaaacttaaccatgcttctaaactaatcttatgaaaattttcttcttctatatgtttatccacacgatgtaaaaaataaaccccacaaaaacgagctaaaatatctaattgaactaataataagcctacaggaacagaaatacctattgcaaattcaattccttttccactaacaacacctaatgctgtaccaatgattgcccctgtgccaaaatcaggaattgatgagccaccaaatgttcctacacctaagaccatcagttgtaatgttgctcctactaataagcctgtattaatatctcccattataattcctgctagaaaaccagaaattgccggtttacttaattgtaatcctgacagataaggatctatacctcctagtatagctaaacatattaaagaaaatatctgaaaaaaagaaatatcattcatgatcaaactaactcctttatattattttgaacttttcactgccccaatatctagtatgccatctaacttaataccaaaaaaatcagttcctaaattataaccatttttatcgataaccttcttcccactatgaatagcaggagatgattgttccaatttatatccatcaaacactgtattctgactgaatcgatcatatgtcaaatagttaaaattaggttttacgggaccattttcaggagaaacaaatatattcgactcttggctattactgatttcaatacacgcctctatattttctgaattttttatttgtaaatactgatcttcaaaaaccaatccattttctaataaaactttatcccctggattttatttaagttcatttattttatttaaacttttaaaagactcagatatagataatcctgaattagtgtcactccctctttgcgaactaacatagtaacaattaccaatggggttactttcagcatgagcgacttttgttaacatagataaactgatcaaacagcaagttgcaataaaatatatttggatttttttatattcataaattcctccacattcattcatcttctaaatctattggatttacttccaaatattcatttacatgtataatattttctcttcctttatttaccaaagaactatcttctcctaaaaattgattattaacaaagcctataaccattggcatattcattcctgcatatagttctatttcttttccttctaaaattaattgagaaacaacattgcaaggagtgcctcccattagatcagccagaactgtaacttttttcaaaccattaattgttttttcgaaatttactcgaaaatcttttgctgactcttcaggtaataaccctacagtataaatatctttttgtactcccatgatcatatcaacacttctctttaactcttcacaaaatcgtccatgactaattaaaactaaatgccccgccatcttttcacctcctcgtatattattatttatttaacagagacataaagtcatctgctttgtcacttggaaccatttgcgcaattaaatggacacctttttcatttaattgattgaacgtttctacatcttgatcgacaacattaattgatttcgtaattgatcgagtctcagaagtttgtgacatatttccaacattaatctcttttattggaacgcccaattctaccaattttaataatcgatcaggttttcgtgcaataatcagtaaacgttgtgaatcatattttcctgctaaaatgttttgcgccgctttttcaatcggcaaaatacttagtttcacccctgctggggtagccaatttcaatccgcttttttcaatatcattttgagccacttcatcatccacaaccataattcgagaaatattcaatttggttgtccataaattagctacctgtccgtgaattaaacgtccatcaattcttactccaataatactcattgttcatccctctttcatttctttatataatggtgcttttaataaattgatttctggttcataggtaccttctgtctcaaaaataacaatttcattcttaccaacttttagaaagccgctagagatgtacagtgaaagcgttggacctacttcccaaaaacgacctatattggtctgattaacaaagacaattcctttaccaaatttccttaaatcaataaaacaatcaccgatatcctctaaaagaaactcatatcgataaaaacttgggtgttggggctgccatccttttgaataatccacagttttacaattttccaaaggcaatgaatactgttgccaatttgtaataaaatgtaagtctgccattactcccgttctaattccttttttttgcgtttccgcaaagagtttatgtccataattgacacgtcccatattttcaatcaaaatatccacttgattgatttcttctgtcatactaacttgtatatcttcacctatttctgtttgatattgggtagcttgtaattcttgattcaaaaataattggctgcgatctctgccatcaattacccgtaatcgttcttcctctgcatccctctctatcattgttcggtaaagtagataacctgtattttgtcccaactcttccattgtctttggatactttgattgaaccggttgactaatggtatctaaagtcgcgaaaagacttaccttattcgtcaaagaaatctttttcttttcaatcgtgggtttaatgacaggatctagctgcttaatctctggataattatcatgaatcattttccgcaatgcataatatttttctgttggattcccctgctcatctaatggtgcaccataatcataggaagtaatttgcggtaaatcaatcactcctcttgctgaacaaccattcataaacccaaaattcgttcctccatgaaacatatataaattaatgcttccttgttctaatacctcttttaccgcttcagcgagttcctgtggatctcgttgaataattggttctttccaacgattaaaccaaccatcccaaaattccatacacatcagtggccaatttttatcatattctttaaaaaactgcttcatagagttgaagttgtcttttgctttagaaccaaaattaccagtaaccaaaatatcatcttcaatcatgcttcccgctcgtaaagtagccctccacggtccatctgaagtgaaaaaaggaactgtcactcctcgcttaatcatcaaatctcttatcgcacgcaaatattccttttcttccccaaaagatccatactcattttcaatttgaatcatcaatatatttcccccattattaagttgatggggaacaatccttttcatcaaaacatcataataatccgctacatgctccaaataagcgatttcattccttcggatatgaatcggttcacggagtagccatgacggaaaccctccaaattcccattcagcacaaatataaggcgatggccgcacaatagcatataatcctaagtcttgagcgattgtcaaaaatctctctaaatccaatatcccttcaaaatgaaactctcctttttgaggctcatgtaaattccaaggaacatatgtctctactgtattaaatcctagtgcttttaaattgtacaaagaatgttcccaatcacatgggggaatccgaaaataatgaattgcaccagatagtattttaaatgtttttccctttaataaaaattcttcctttatttcaaatgtagtcatctgttacttttcacctcaatgtgttaatatacttagtatattaatgcttttgtattaaaagtcaacaatttttttttaagtatgttaatatagatgcgagtaatttaaagggggagcttataataaaaccgaaatatctagaaatcaaacagaatctaaaacaacaaattgtaaccggtcaatttcataatggcgaccgattctattcagaatcagaaattatcaaaaaatataatgttagttctataacagcaattcgtgcgttaaaagaattagttgccgaggggtatatcgtacgttatcaaggaataggaactttcgtttcacgtgcaagaaaagaaaaaatagtaaaattttctgatatagaaatattttcatttgacaatgataaaacacacgttctttcgattaaacgcgaaaataaaaaacaaatattagatacattaaaattatcaactgattcatattattatcaaatcgaacgaattagagaagctaatgaaataccttatatctatcataaatcttatttgccagaacaatatataaattctaattatccagaaattaattattacaattctatttacaaacgtttaaaatcagactacaacattgatttaaacgaagaaaactttagggaaacaaacgaaattttatttcctgctcctaatagtgtatgtaaacaactaaaaataaatgaatctgagcctgtcgtttttcaaaccaaattatcctgcttatctgaaaataataaacctatagaatatgttgaaagttataaaaaatggaatttctataagattcaactcctatctaattaactactactgaatttaattttactttgttcgttatagcaatttttcataattaaactatgttaaaaaatgaggttcttactatgaaacatatttcagtattgatcaaacccgcatcttccctctgcaatcttcgctgcagctactgcttttatgccaatgtcagttccttgcgagaagtccgctcgtttggcaaaatgaaagaagaagtgacagagaaaatgatcgaaaatatttatgcagacttagaagacggcgatcaattaacattagcgtttcaaggtggagagccaacgatggcgggcctcaattattttcgtacagtgatccggttagtagcgcaacaacaaaagcaggtacaggtccattatgcgattcaaacgaatgggaccatgatcaatgaaaaatggtgtgcttttttgaaagaacatgattttttggtcggtctctcgatcgatggccatccgctctaccatgatctgcatcgggtcgatccgaaaggaagaggaacttttcagcgagtgctgcaaacaaaacagctgtttgactactatgagatcgactacaatgtactttgtgtcttgaccaatccgttggcaaaagaggctaagaaagtctttcgctttctaaaagagcaacaaattgattttgtccagtttattccttgtttagatgatctagatgcaaaaaaaagaaatagttatgctctcacaccaaaacgttttgcaggattttaccaccagcttttgcagttatggctgcaagaattagcggaggggcattatataagtatcaagctttttgatgatcttttgaatctattgatcaagcgacaagtcactgcctgcgggattttaggaaactgtcaggtacaatatgtcattgaagcagatggcagtgtgtatccttgtgatttttatgtgctggatgagtatcgcatggggtatattcaagaacagactttacgtcagttatttgaacaggacattgcaaaaacgtttttgtgtggacgccccgaaatgccaaagaaatgtctgagttgcccgtttcaaaaaatgtgtcgtggcggctgcaaacggatgaaagatgccatctatgtagataacacaggctattgtggttatcagcaacttttgcaggaatttgtaccgcagattaatcggattttaggtttgttacagggggtaagtgtgtgattgggttcatttattttatagtgatcgtgttggcgaatacggttggtgccgtttcaggcatggggggcggtgttctgatcaaacccatttttgattttatcggtgcccattctgttgcagccatctcgttttattctaccgtagccgtgtttaccatgtcgctggtttcgaccgcaagacagttggctagtggacgtaaaatccattggcaaatcgtcctttgggtttcaggcggcgccgtcttaggaggcatcttgggcaatgtcgcttttgatcacctgctgcttttatttcagaatgaagatgaggtacaaatgattcagatctttttgaccgttgtgacactgctgtttgctttcttttataccaaatacgactggcccggattccaactgaaaaataacttctggtattgcttctgtggcctagtccttggttttctagcgagtctgctgggcattggcggtggaccgatcaatgtgtccttgctgatgctgatgtttgctttacccatcaaagaagccacggtctattcgatttgtacgatttttttctctcaattggcgaaaatcgtgacgattgctgggaccactggatttggcctctatgacttaaagattttgtggtttgtgattccagccgcgattgttggcggtttgttaggggcaaaagtcagcactgtcctctcaccacaaaaagtgacgctggtcttccagacagtcatcttcttggtgctaatcatcaatctttataacggctatcaattactataaaaaacgagtattatcaaccacttatagaaaacgattaattagtaactttagaagtactttctcattaagaagcgctcttttttgtgacttttctgaaactagaataaatactctcaattgcattagtaatatgcatgatttttctaatagcactgcctgttcaccatgtgcaaagtaccgtttccagacatctactaacaaaataggctctttgtcaataaggactgatgagttgtgcaaaatcaaatctgggtcagaatgaaccacattctggctcagattttttgttatcttacattgattaattgattgatcaaaaagattctaattctcatgttctcgaatgatttaaatccgtaggatactcgtttcattgtctttatgtgggtattcttcgcttcaatttttccattggaataaggatagatcattgcgttggtgataccttcttcataggtcagaaggttttgaagcttctcccgaaagccgtcatctaacgtttcgggaagttctgccaataaggagaaaaataagtcagggtctttgtctcgaaaggcttcgactaattcatgaaaaaagggatacgcctcctttagaggcgcagaaaactcaagcaatcgatcaatcatcattgcttcagtgagaaatgggtattttggtgctcggaaacttttccggcgctataatttctaggactgatagaaaatcattctatcagtccttttgagcataaaaaaacaaaacatacagaagctccgttagaattgaatcaccacaacgtaagcgccccatagaacagtacctgtacgtcaaataacggctctataatttatgggactgatgaatcagaattgattcttcagccccatttttattttaggtattaaaaaacatatcgttctctagtatgattaaatcacgacaaaataaacaactgagaggacgatatgctatatgaatgattctatcaaaaaaatgctgcgattaatagagaaagatttgatgattacagaggtctcttacgagacctttcagaagaaaaagacgttgatcgtcgatgctgttttctcacctgctccccatacctgtagaaattgtggttctactgtggtagatggaaacgggaaagtaattgtagtgaaaaatgggaagaaggaaacgattgtccgctttgaacaatacaatcacatgcctttggttatgcgcttaaaaaagcagcgctatacctgtaaaaactgtcgaacccattggacggctcaaagttattttgttcaacccagacattcaatcgcgaatcatgtcagatataaaattgcttctttactgactgaaaaagtatctttatcttttattgcgaaaaattgtcaggtatctttgaccaccgttattcgtacgttgaaagagtttaaaagctacttaccaaagcaatctaagaggattctccccagagtattgatggttgatgaatttcgttcgcacgcttccatagaagataaaatgagctttatttgcgcagatggcgaaacaggacaattaattgatgtcttgcctacgcgtaaattgcctcgattaacaagctatttcttaggctgcactaatcctaaagaagtaaaatttttagtcacagacatgaacgccgcctacttccagcttaccaaacgtattctgccaaatgcgaaagtagtgattgatcggtttcatattatcaaacacatgaatcaagcctttaatgagttgcgtatccgtgaaatgaatgaacttcgtaaagtaggacagaaaagtcaggcagaaaaactgaaaaagaactggcgctttttgctaaaaaatcgtgcaaacatcaactattatgaatacaaaacatggaaaagttttcgagcaccaaaatacccatttcttacggaagcgatgatgattgatcgattgcttggcttttctacgtccctgaaggaggcgtatccctattttcatgaattagttgaagcctttcgagacaaagaccctgacttatttttctccttattggcagaacttcccgaaacgttagatgacggctttcgggaaaagctccaaaaccttctgacctatgaagaaggcatcaccaacgcgatgatctatccttacaccaatggaaaaatagaagcgaagaatacccatataaagacaatgaaacgagtatcctacggatttaaatcatttgagaacatgagaattagaatctttttgatcaatcaattaatcaaagtaagataacaaaaaatctgagccagaatgaggttcattctgacccagatttgattttgtacaacccatcagtccttattgacaaagagcccaaataacccgacctatagaatagaatcgggaatgtttggcgtttttagttacgagaaaaatgttgttgtacatccttgttccaaggcaacagttgatctaaagtttctgctgaaagtacgggaagatttggtatcttatcaaatagaaactctagatactttacaggattcaatccgttaagttctgctgttttatatacactcagaatgattcctgaagttcgtgctccttcaagacttgtggaatgcaaccaatttttccgtcctatcaccagctctttgatatttcgctccgcacgattatttgtgagttctaaacgaccatcttcaaaaataggttcaaaaccacttcgtagtttacacgcatattgaacggctgcatccaacttggattttgcaacaggatctatcgttgccatccactcataaaaagcaataaataatggacgcagttcttgttgccgacagcttaatcgcttctcaggagaaaagtctttccatttcttttctaggacaaaccatttatccaattgtttgactgcttgagctgcgggaatatccgtgtttttctttccttttggaattgcttcgaaaaatttccgccgaacatgcgcgaaacaatagacaagtcgtacactttccacggcattatacccgctatagccgtcacagtgtaaataccctgtaaactccttgagaaaagttttcggaacatctccagcacgactttcgtcgtggtgataataaacgatgggatgctgactgtcttttcctgtacaaaactgccagtaataggtatctgttttggcactttcaatcacacgataacttgtttcatccccgtgtagaatctcttcttgattaagatagactcttaatcgttctcctaaagggtctaacgcgttttgcactgctttaatatgccaattggtgatattatctctcgaaatatccaacccatgtgtttgtttccaatagttctcttgccgataggcaggaactttctgaccaaatttcatccggatcgtttccgccactaaactattggaacctaagctattagaaatcaaaggtttaggaacgatcgcttttttaaaagaagaaagtccttcttttcgcagcttttacaacaataggtatgttgataatgggtgagacaatccaacatagcctgatggaaacgaatttcttctcgtacttttgtccgtccgatatctttcatctgtgaaccgcaatgttcacaaaattgttcttccaaaggaaggagatgttctttctctctgttataggtaagtgtttgattttgtctgctttcgttcctacaactcgttgatgtccttttactggaataatggtggcagctgcttctggaacacttacagaaatttcttcatcactaaaaagattcaattgcccattcgtttcctcaaagagagtctctttagagcgtccaaataatttgttggttaaataattgaccttttcattcaatagttggatttcagttgtaagattctgaatggtttgttgttgtgcttgattggttttatgggcttcttgaagcaactgaagcaacgtatctgtagtttccaaaatttttcaccaccttgaatcgaactgattttgttacagaataccacaagaaacgcacaagaaataggggttcaacacattttttgtgttaaccccccagcttaaaaaactcctttttttcctggcaaaatagctcgaggttgatcgatacttaatccttctaacaaccatcgaacctgttggttcgttaaggttcgaacttcgtctttcgtccgaggccattttaacttgccgttttctatccgcttataacagagaagaaaaccatcaccgtcccaatagagaagtttgaaacggtcttgacggttcccgcaaaataaaaaaacggcatcttcgtaaagctcgagttgatactcttgttgaataagactggcaagaccatcaattccttttcgcaaatctgtttttccgcacacaatataaatatgtttggtttgaagtaaatcataaagcattggacaacagttctttcaaaatagcttgaagaatataattgttaataccgttatagatcaaaacttcagaaccattctctcttttgatgcgcatcgctaacttggcagccgcgggtttacctttttctggtgcactcttttcgtttcctaattggacaggaacaatctcatttaatttatacatagaaaacctccagacttcttgatagctcaagtatatcttgaggtgcatttgttagtaaggtactgttctatggggcgcttaccatcgtgtaatcacctcttgatcttattgtagaaaaagaaaaaccgcgaagcaaccacctgcctaggattaatggttacttacacggtttatattacactctcatcattaaaaaagtatctttcgatattactaaacaatgaaattatctatttgaaatttaaatctgataatatattgagtgttccaatgagggctttgatcctattatccatatctttttcagttttaatattgatacacattataagaaaaagaaacttttggttaatttatttcatcccagtgcaaaatataaaaaagtaaaatagaccataggcaatagattaacaattaatataatacaagcaaatattctattcattgtatttctgctttcaaaaagttctaatattgaaagtataattccacaaatgcctataataagtatgggaataagattagaaaataacaccccgagccaatctgtgaaaattactatatttactaatatccctattaacatacctatcatatttattaaatcaattttttcattagatatttctcctttattaaatctgaagtacttatattaaaataattctaaactatttacctcaaaaagtgcaataaattatttctgaacaataaaatgatagtcaaaacaaaaaatattgttaatcgttcagagccatccgagagtataaaatattttgtgtaaatgaaaaaatccatacaaaaaaggaagtcccttctgtagaataaagttaacgacaaccaattcacagaaaagaggacttccctatgaatgattttactacagaaattgtgcaaactctagtcactaaaggcgatttaaatgaattattccgttcgcacttagaaaaagcgataaacacactcctacggactgaattaacggctttcttagattacgaaaaatatgatcgcactggttttaattcaggtaattcgagaaacggttcttactttcgatcaatcaaaaccgaatatggtgaattaacattggaaatacctagagatcgtaatggtgagtttaaacaacaaactttaccagcctacaaaagaacaaacgatacattggaaaccactattatccatttattcgaaaaaggtgttacgatgtctgaaattgctgatttgatcgaaaaaatgtacggtcatcactatactccacaaaccatgtccaacatgactaaagttctgactaaagaagtaaatgcctttaaatccagagccttaaatgataagtatgtcgctatttttatggacgctacttacattccactaaaacgtcaaactgtatccaaagaagcgatttatattgccattggtatacgagaagacggcactaaagaagtactgagttatgcgattgctccaactgaatcaacatacgtttggaatgagctgctacaggatattaactccagaggagttcaagaagtcttgctttttattacggacggcttaaaaggcatgaaagatactatccatcaaatttatcctaaagcaaaatatcagcattgttgtatccatgtatctcgtaatatcgctcataaagtacgtgtcaaagaccgaaaagaaatctgtgatgactttaaggctgtttatcaagctaactcaaaagaagaagcgaataccttcttatccggcatgattgagaaatggaagaaaaactatcctaaagtgacgcagtcactcatagaaaaccaagacttattaacttttatgattttccacctagcattcgtagaaccatttactcaaccaatctaatcgagtctttcaataagcaaattaaaagatacagccgtagaaaagagcagtttcaaaatgaagaatcactagaacgctttctagtcagcatttttgatacatacaatcaaaaatttctaaacagaagccataaaggttttcaacaggtaaccgatacattagtttcaatgtttactgagtaactaattattttgcaggaggacaatttatttacacaaaattattgacgctccccccctaatttttcaataactattgcaaaattatatcttaattaagaaaatatttttattttaaagataaaaaattcttcatcctgcaatactttatattctatattgtaattattcagaatattacttacaatatataaacctaatccattactattttccttatttaaatcaaatttaacatcaaatattttatccatattcgaaattttattgttaccgtatgaattctctatatataaccaatcattaactatcccaatattaattaccccatttacatcagtatattttaccgcattactaatcaaattagatagaataatctttaaagctgtttttcctatataaacattctcgtctaatatataattattgacagttattttcttttgatttgctaatatttcatacttttttaatatgtcttctaatgtattatttattttcaaatattcttcatcattattcaaattttctatagaatgaactgataatatttgagaaatattttttgttaaactatcaacgatttcaatacattcattaatataaatatctctttctttatattttccaatattgtatttcatgttttccagtattattttaagactagcaagaggggttttaagttcatgggatgcacctttaaaaaagtcatattttaacttttctaattttaaaatttctttatttttaaattccaaatcgtcaattgttcttaataaagtagaatacaaatcattaatttgttgttttaattctccaacttcatcattagagctaacttttaaactcatttttttatcaagtttcatcattttatcagtaacaatttttatttcttgtatattattttttattgattttgcataaattaaagaaataatagcagaaaataaaattgatattaataaagaatatggtaaaaatttaaggcttaaatctttcgcatctttttgcatatcagctgtagaaacaaattgtagatttgtttttttaccatcattaagctttatttctctttcttcaattatcaaagaattactatcactttctaaattaacatttatattatctttgatttgtatttcattcttattatttttttcttttatgaatacttttatttcactactcttggaataaaactccaaagtttgttctatatattttatttcttttccattcatattactagaaatttcatttgccatattatgaatcttttcttttctcgtctccaaatatgttttaggaaagataaaaaaaattaatgaatgaactaatataattattattccaagaacagaaaatatttgtatgaacatttttggaaatatctttaattttttcattttctctccaatttatatcctacatttcttatagtagttatacagtctaattgtaatttttttctaagttcttttatatatacatctattactcgatcataaggagtttcttcgctatctttccatacataatcaataatttgcattcttgttaacacttgtccattattatccaataaacattttaatacttctagttcttttgcatttacatctatttcttcaccatttattttagctgtatagctattaaaattaaccgatagatccttatattcaaacttctctaaatgtccataattcttcttaattaaagaatctattctagcttttaagaccggcaatgaaaatggcttttctacatatccgtctactaaattagtaaatgcatcaattttatattcttcatcactaaatgcagtcaagattagaattggtaaattgcttttctttctaatttctttcaacacttctaaaccatttataaaaggtatctgaatgtctaagataaccaaatttatatcgctattaaattttgacaaggcttctcttccatctttagcttgaataacagtatatccaaattctgaaagatattcacttattccctctcttatcatattatcatcttcaacagttaatattttcatatatacctccacttaagcctatacactagatattatacagcatattatggctctataatatctagtgttggtgacaccttctgttgccaatactttttcttttttctaataaatgcaaacagacaccttgaaatcctttagaataaagggttctataatattttgtgttgttggaaaatcgaaggcgattttctactaacactttttcttcgtttcaactcaaaaagagactcacttttggtaaaatttagtcgaccaaaacatcaccctaccaaaggagtcgctctatggataatcatactagaaaattactcggattaacagataaacatttattttttgatgaagaatggctgattgaaaaagaatataaaggcgttcaagcgcagtttattaaagggagattggatgactcaccttcccattgtgaacactgtggatcgattcgtattatccgcaacggttcctatacgacacgtactcagatattgaaagtcaaagaaaagttgactattttagaattaaaacgtacccgttttctatgctatgattgtgggcagaccttttctgcgaaaacggacttagttgatgaacatcatcaactaacaaaggaactgaagcaggcgattctcatggaactgtacgaaaatcaatcacgtaaactaatcgctaagaagtacttcgtctcggatgggacggtgacacggatcttgcgtgaagcaacgaagcattaccagccacgtatgaacttccttccgacggtgttgtgtatggatgagttcaaatcaatgaagtctgtttctggttccatgagttttatttgtgttgatgggacaaccaatcagctatttacgacccttgaagatcgcagactttacaaactaactcaatacttcctgcgctttcctagaaaagcccgtttaaaggtcaagtacctagtgatggacatgaatgccagctattgtcagttgctaaaaacagtctttccaaatgcggagatcgtaactgaccgctttcatattgtccaacacatcaatcgcagcttcaatcaattacgtgtccagatcatgaatcgttttcgaacctcacactctgaaaatcagaagaagtaccgtcggctcaagcgatattggaaactcttactcaaagattccacgacattggagccactcaaacggcattatcatcgactgtttaaacgaccaattagtcaaacagaaatcgttgatgagctgttaagctacaacgaagaattgcgaactgcgtatcatttttgtcaattattacgctattatttcgttaaacgaggtacggaaggctttcaagaaacccttaaaacaatttcatctacgttacctcagtcgtttaaaaagaaattcacgatcttccatcgctaccaatcgggtatttcaaatgcctttaaggtgtcccactcaaacggcgtcactgaggggctgtataacaagatcaagctgattaaacgaattgcgtttggttatcgcaacttttataactttcgggcacggatctatttacaacaaggtctgatctttgaaaactaaaaaaatatgcggcgcacagaacgcgccgcatatcggactaagttttattcaaatttgtcttcaccaacacgatttgacgaagagccaaaaattatcgtacttgattacggtagtcagtataaccaactgatcactcgccgtattcgtgagttcggtgttttctcagagttgatgagccaccgcattaccgcagaagaagtaaaggcaatgaaccctaaaggaatcatcctttctggcggaccaaacagtgtttatgatgagaaggcctttggtattgatgaaaagatttttgatttggggatcccagttttaggaatctgttacggtatgcagttgattacttataaattaggcggaaaagttaaaccagccaaaaaccgtgaatacggaaaagcagaattggaaatcacttctgcagaagcggcccttttccaaaacactcctgaaaaacaaaccgtttggatgagtcatggtgacctagttacccaagcaccgactgatttcgatgtcgttgctaccagcaaagattgccccatcgcatcgatccaaaatgcagaacgcaaaatgtacggaatccaattccatgcagaagttcgccattccgaatatggaaatgacttgttgcgccattttacactagatgtctgccaatgtactggtgactggacaatggataacttcatcgacatggagatcgcaaaaattcgtgaacaagtcggtgacaaaaaagttttattaggcctttcaggcggagtagattcctctgttgttggtgttcttttacaaaaagcgatcggcgatcaattaacatgtatcttcgttgatcacgtattgttgcgtaaaggtgaagcagaacaagttatggaaagtcttggcggaaaatttggcttgaacattataaaagtcgatgccaaagaacgtttcttatcaaaacttgctggcgtgtctgatccagaagaaaaacgtaaaatcattggaaatgaatttgtatatgtcttcgatgatgaagcaaccaaacttgccggtgaagaaggcgtttctttccttgcacaaggaaccctttataccgatgtgatcgaatcaggaactgaaactgcccaaaccatcaaatcacatcacaatgtaggtggattacctgaagacatgcaattcaagctgatcgagccattgaacacattgttcaaagacgaagtacgtgaattaggtacccaattaggcatgcctgacagcatcgtttggcgccaaccattccctggaccaggcttaggtattcgtgtccttggtgaattgacagaagaaaaattagaaatcgtccgtgaatcagacgctatcttgcgcgaagaaatcgccaatgccggtttagatcgcgacatctggcaatacttcaccgtcctaccaggcattcgctctgttggggttatgggagatggccgtacgtatgactacactgtaggtatccgtgctgtcacttctattgacggcatgaccgctgactttgcccgtatcccttgggaagtcttgcaaaaaatcagtgtccgtatcgtaaatgaagtcgcacacgttaaccgtatcgtgtatgatattaccagcaaaccacctgcaacagtggagtgggaataagacgtaaatataatatggatggggaatgccgataaatcaacgtttttcaacttttgaaatgcttgattttcattaaaaatgatatggttccctaccatttttcctaccaaaaaagggcactacagacataagtccttgaacaagcgaaatatccgaacaataagagaattgctcctacggtccagttggtcctcgttgcaaaacgatagtttttctgctatcctagtctcttgttcggatattttttgtctattttcacttctgtcacagtcccttttttaaagtgacagaagttagctgatatctcaagtatgttcccacttaaataatcaatttaaccattttttatttaattttgttagcgattgatcgagcggctaacgcagttgatggtatgtcgcattcctctaattgcaaccgaggtttcgaaaatattttctgctggtgccaatcccccgtatccagcatctccaatatgttgtaaatcaacaccacaacttttattcataatggctaattgccgcaatgtttctggtcgggcactttcctgactagtaccgattgcagacatcgttaacaaatcatatttttttgccaaccgaaccgcttcaattaggtcttgctctaaaaagcctgggatagaccctactgaaggaactagtaaaatatctgcgcctgcttccgcataagaaataatcgcctctttattcacaactggctcttctgagccggcgctatgcattttcccagcaataatcaatcccgaaaaatacttttttgccatttttacggatttagtaatttctaaattggttactccagtgcctggattaccggtaaagcaaataaaatcgactcctagttcttctgctttttgtatcgtttcaacagagcttgctcttccttggctgatttctactttctcactcatcatatttgttttaggggcaatgggttctaaattaattcccacaggacgaccgactagttcttttaatttaggaatcgggttttcaatcgtttgctgtagatcaaaaaccttctcaatcgtcacatttggtagtccaaaaactgcaggacgataacaatcgaaaccatttaaaagaatcaaatctgcaccaaatgctgacgcaacttctgcattcgtaatttctccagattgtggaagagtattagcaaccgtttcacaaacaatcacccgtccttcactcgctttgatggattgcttcaactcttttgacgtcattttcttgacatcactgtagtttgcactaattaatctcttgaccattttgttctcctttttcttgctttttattttttaagatatctaacttttgataatttgctctaaatgggcagttactaaatcacgtcctatgcggtgtgtttttttcttagccaaccattcttctgcttcttttggatctttttttaattgccattcttgccagaaagtccaactttctgtgattgcttgtaaccaaggctccaattctgttctcaatctagatgtatgttgttcttgctggatccattttactgcttggactaaagcagccatttcttttgtgacccattctgggtctttggctagcagtaattcttcatctgaaagcagactgcttgtgtaatgatttggaaaagcattggttaaggtaagataagctggttgtagtttacttccaactactttttcaacgactgacgtccaagtttccaaaggatcaaaacgctcacagttccataagtaattagccatactattgatcgtaaactttgaagcttctaattgagccattggattcgaaactactcctgtaacctggtatctctccttagaaagattcggtgttcgattctcatatggactcatgaacaatagttctttatcctctaaataatcatttaccggaatattatcccaaatcagcatcggccgttgatagacagaagccatttcctgcagctcttctgtagaaattgacgccgctaacgtgcttgggccagtccaaaagaacggtaattgttctggtatttcttgacttaacgttgctaaatagcgagaaccatgacgattatcatattctgtaggacaaatgactaattcatgattggacaaccgagtgctaagatattcctctactcgattcactaaataggcatgagcgaatgctggctctcgaaaacggcgtttagcagcaccttttaattgatagtcaatatcatccattaatagaccaaattgaaatacgccaagctcaatcagttgttctaactttttcagaagaacttgaatgtcttcttcacacgtaatatcaatatcatttccaggactaattaagtaccaaaaatcgatattgctagcctcagcagcagataaaagctccttaaatttgtctaattcttgcgcatcgtagagttcacgccattttttacgtaataattcatcatctttaggggcatacataaaagtattcaattggttatctttcatatatgaaaaaagagagaggcgcatttcatgtgtccaggggataccataaaacccttcaatgattcctcgaattttcactgatggttcatgtttcagaatcaattccggtaataataattgatctcctaccgaaaaaaaactctctaataaggcttccatagcatattgaaaccctcgaaggtttgctgattcaatcgtaagttgattgtcattagtaacctttaaataaaatccgtcatttttcaaatgctggttataaaggtgtgttatacataaatcgtatgtttcttttggatcatttatgagctgtacaggacatgattggaaattcgttaccggtttccagacttcttctaactgttcgaaacgataaaataatccattaaaacgaacattcagcttattttttgaccattttaagcaatggtttcgataaacaacttcttgataacgagataatttttttttgacttgattgatctttgtttctttcatctattttctcctttgaaagtaatcactatattccagtcaaaagtatcttccataaaacggaaacgatcttctaaataaggaccgcaactgtgtgagccgataccattttgtttataacttaaattgaaccaagttctattctcttttattaattcataatggtgtgacttttcggttaattgagcttgactataaggcagagcagaaaaattagagtttccataaaccgtcatggtagatccttgatgatttttgattgatacccaatcacattgccagcggttaccatattcttgtggtttgatatatggctgatcaaattcctcaatctccatctcataaataccaaacatcgcagcatagtgcttatcaggataactttcatacggcccatagccacaataagaaaccttcgaaaaagtatcattcaacggccagtccatcccaaagcgagggaaatctggaaaaatcggatttttctccactgatactttttggttgattacgcctgcaccatttattttcaactgtatgtgcattgtaaaaattggctgtaatcctggaataactcctcgataagacgtttcgatcaggagatgatcatctacgaatttccagtctttttttctgatttctaaagacatttcagcatatccagctgctttccatttgtttactaagttacgatcattatccgttggtgcacgccaaattgaaaattgagtaggacgttccaaaagttccttttgattgatctttacagaagtgaacgcagcttttgctaattgatatatataaataaaggattctcctttgattatcagctctgtgccttttactgaaatttgtggtgcatcattatgatgagcagttcttggcaatctcattttttcttttttaagaaagagctgttgctgtccataaagctcatcatttttataaacagatagcgaaacagcaaccgtatgagcaccatgaatcgttgtaggtactgtgatgggcaatgaacaacttttgccaggctcaagtatgaaaggattcattacttcataaactgttttttttccatctatataccattcaagagaaaggttaaatgctgaaccggctgtaaaagcagttatattgctcaaggttacttcttgcagctcctcatctacagcaatcagttgaataggcgaatgaatattacggtactccaatgcacctactgttaattgccgatctggggtcaataaaccatctacgcaaaaattgccgtcgtgatatttttcaccaaaatcaccaccgtataaataagatggcgtttctaaagttcctctattgattgcatgatcagtccactcccagacacaaccgccaagaaaggaatcatactgttgaatcaaatcgaagtacgttttaagatctccaggaccgttgcccatagcgtggctatattcacacataaaaaaaggtttttcagtatcacttctttgacaatgacgatgaacatcttccagtgggggatacatttgactaataacatccaagttactaaaatcattcacttggtcaataactggttcaatcgagcgttcattatgaatcaaccgtgaatcatccaatttccgtgctaaagcttgagctttttcaaaatttactccataaccagattcattccccatagaccacataatgatagagcttcgattttgataaggaagaatagaacggatcactcggtccataatcggcttttcgaatgtcggatcattagcaattagttgataattcgcttcagtatcatatagattaaccacaccatgacactccaaatctgcttcattgattacatacagaccaatctcatccgccaattcataaaaatctggtgatttagggtaatgtgccgttcgtacagtattcacatttaattttttcattaataacaaatctgcacgtaactgctctcgggtcatcactggcgtaccttgctgattcacgtcatgatagttgactccatataatttaataggtgttccgttcagcaataacttacgattcttgatcgtcagtgctcgaaagccaactttttctttaaaatattcaccattacatgttaaaagtaatgtatataatttaggcgtttctgctgtccaaaaaaggcaatcttcaacatccaaatttatttgttgttccgagtaacactcccctttcgctatgagacgtccatcaggatggaataattcgtaagaaataggtaacgatacttcaataggagtaaatcgttgaaaagaaaccattaatgttccgtttccttttttaggatcagtcaacgtccgtagttgataacttgtcagatgcatagttggtcgttgaagaagatacactggacgaaatagaccgctcattcgccacttatcctgatcttcaaagtaggtaccatcacaccacttcatcactagaatttgaatttcattaaccccaacctgtaaatacttggtcacatcaaattcagatgtactatgactcacttggtcatagcctacaaagtttctatttatccaaacaaaacaattactatctgctccttctagatttaagtaaaagcgtgcatctgtttgctcaatttgaaactgacgccgatatacaccacaaggggtatcattaggtacataaggcggatcaaaaggaattggataagatacattgatatactgaggtaagtcaaatccctctgtttgccaaactccaggaacagaaattctatcatagctttcagtaaaggcctcttgaaaaaaattttccggtaactgttggacagaaggataatactgaaaatcccatgtaccattgagatcgataaactggctcgttttttccctttctaactcttgttttgcttcttctttacttgcataaggaatataataattacgtaatggttctgtattgacacttataactgacagattttgataatagtccgataacatattttctcacttcctactttttttctcttcttaataaaagagttagtggtaagctacttatgaatagaaaacgaaccactttcccattagatgagcaagtggtccgttcaacgggaagattccttcgttaattgtagcctgacaccgagctttgccgataattaaagccagaaatttcaagcggcacttgatattgacaaaacggtaatcgttcttccaaaagctcctctagggcatcttgcccctgaagatgatttttaatacgacgcgcaacggttttcagacgatgagctaatgcagcatatcgttgttctaatacttcccaaccataggttttgtatgtttgataccaaattatttcatgaatagatgccaattcatttactcgattggctagtgcttcacaccgattcgctaattccattaatcctgcaaggtcttctaccagacagcagtgttgtaaatagatgcctagttctgccttttgtgctaaaatttcagctaaaagtatatatcgttgacgaatagttgttaaaattggttgttttggattccaatttttattcatatctaatttctgagctaactcatgataataagtaccaattgttctagtggcaattttgttatgagcggctacatgaaagtcatatataccaactaacggatcttgccaaagtagcagtttactcacggaagccatttgtaagttgttatttgtaatggtatccacttcatcgaaatatcgtaattcggacattaattgataactacctgttcctaataaacgatcgtagatttcctcaaaatcattccactcttcttcagaatagacataatctgctaattttaatgccccaattaaggaatgccaatgctctgtttcctgcccttcatctccccaagtagttaacatcacagaacgtacacctttatttttagaagcttttacagctgcagaaacaattgcttctgttttcccatgattcggggctagtctcccccagatatgggcaccactagctaaaacgtaatgatcaatgtcacaaaatttcaaatggttatcaattactttctcataggaggaaacttcatctgaaccatagtcccaatgaacataggttaatcctgctggtaatcctttagctgctaatgctttgagtttaaaatcaggattgtaatacctatctttaccggtttcatctaatagcttataaatgaaatcactccaaatcattggtttcatcttatatttatcaacaattgataacacacggtccatatgttgaatcattaaagttgtccgatcacaatacccatacaggcttaaatatcgtcccagacctgcttgataggcttcatccattcccaaatgaatacgctctgtctgatacatttctttgcaggcaataatcatcttttcgattgccgcataaaccttttcttcaccgatcagtagagtattttgatcatccatcagttcttgttgagcataccacttcaaaaattgggtcaagtgagcaagggtctggatcgatggaactacttctatgccaaaaccagaagcaaattcaacaatttcattcacttcttcttttgtatacgctccgcgaaggtaaccaaaatatggaaggtcttctacttcataggtatcttctgtgtaaatatacaatgtgttgtaccccatcaacactaagtaagaaatgaatttttttagagtctctttattcatcacgccattacgagaagcatctaatgaataactggtctcaatgatcgaggtttcttcaatgtatggcatctctcctccttgagctaaaaaacgtggaaggcagataaacaatcctcgatacagcaagtcttcatgtgaataagacaagcagattcgttgctgctcatttttagtaatcttgatttgtcgcacattagcctttgtgtcagtaaaaatcaagtctatttgttcttcatctttttgtgtcaatggaatctcaagttgctggataaaggctatattagctacttgtttatcagttaacttcatagaaagaaatactcctttttgtgaaaaaattagtgcgattgtatctgacaaggcaactttgctaacgctctttcagttaatttactaatcaatattaccgttacagctgttccgccaaacagaaaaatcacaggcaaaatcatcaatatttggaaataaattccaagcaccaagccttgcatgactaccgttggcaacatcgttgctgtgaaaagcaaatagtcaatcagtcggtctcccatcatccacaacccaagacttttgatcacgacccaattcaacattgcaaagactaggaacagtgtaattaccgataataatgtacttaataaataaaacaatggtgcgctttgctgccaacaaagccagatcgtagtaatattgccggccaacaacaaagttgctgaccagcaatatagattatatctaacaaaatttttcttatagattttactcatgaacttcacagactcttgcaagccatatttttttcgattcacaacgccagcaatcaaagctatcgtagcagggaaaaaacctaaaattccaaatcctaaacaaattagtataaaataagtaaagtttagtaacaacaattgaaaaacccaattaaatcctttgatccatttgttttcgttcatttgaatccccccactaactgcttagtctattcttttcatttagtaaaaaattatttgttagattttcgccattcatcgtattgttcttgagcagatgcctgaattttatccaatccagctttttctagtttttctaacaactctggtacatattgttcagggtcaactgttcccgagcttaaaagtacttcatattgtgacacgatattttgtacacttgcaatttctgttcgaaaatcagaagcgtcaaaagagaaacctaaaataggagacatcggtgcttcattttgaaactttttactttcttcttctagttttttactttcttctgtaatcggtgaagtttttgaaactagataagtatttaccaatgcccaagcgccttgataataatcatcagagtttgttaaagtaatcgaaccatcttcattgcgatcatagtgttttccttcaattccataaaccattaaatccgctacttcttgattggtattcacataattcaacaatttcaaggctgcttccggatgtttacttgaagcagataccgcatgcattgccactcttgcaaatccagtcgttttaaaagcttttccagctggttttaaaattaatccatgtcccgctagagcttctaattttttttgtgctaatggttgataaccacttgagttacgacctaaaaaccagtttttactatcaattcgaaatggatctgtcgtaacagtggctgcatctttcaaaatatatccttttttataaaactcatgcatagccttcaaataagtcatcatttctggagtctcataagtattaacaactgtttgtgtatcgccttcaaatgcaaccgctagcggtacaccaccaccgataatattgtcataaggaatacagacactggtacgggtcataccgattggcgtaatattcgtatcagtatttttttctgcaaacttttctaatactggagccaatgtttctacaccttcaacattctctacatccaattggtattgatctaccaaatctttattaaaggtccaatattccgttgtggcaatatcgttattgactggcaatccataagtttcgccattaattgccccaccttcaataaatccttcattcaattcagctgcataatctttcaactctttatccaaatgatcgttgagactaatgaaagcacctttgttcccataattcacataatctgtgccattgacgaaacaaatatcatattcttctcctgaattgatcatcacaccaagcttttgctgataatccccgtccggaatcagccgcatatccaactctacattgatttcttcctttaatttttcgttgacttttgtcatgacctcatcaaaatctttgggttcttctccaacctgataccaagtaacttttgtggttcctgtttcattatttgcttcgccattactgctaccacaagcacctaataggccaagggttagtacagaagcaccaccaatcaaatatttctgcatgttctttttcatcttttaacatctcctattcttttttattctttcactccaccgatcgtcaatccttgaacaaagtatttttggaagaacggataaacaattgcaatcggtaaagtagctactacgaccattgccattcgtgttgattcttgaggaaggctattttgaattgcttgttgctgcgctaatgtaatgtcattattatttgctaagaattccattgaattttgaatcttcattaacaaatattgcaatggaatcaatttgttggtgtcaatatacagcaatgcgttgaaccagtcattccaataacctaagcttgaaaataaacctattgttgcaacccctgggatcgctaaaggcaaaacgatttggaaaaaaactcgaaactcactacagccatccattttagcggattcgataatcgattctggaatcgacttcttaaagaatgtccttaaaataatgacattgtatgggctaaaagcaagaggtagaatcaaagcccaaattgtattttttaagccaagcatcttcgtcatcactaagtaagaaggaaccatccctcccgcaaataacatggtaaaaaaaagataaaaagtaaagaacttccggtaagggaaagaggctcttgataaaacataagcataggttcccgtcataaaaacagtaatcaacgttccaatcactgtaatcataattgtaacgcctaatgaccgaagtaactgtccgccatcttgtattaagtattgatatgcatcagtgctccattgagccggcaataattcgtaaccgttgagttgtaatgctttttcatctgttaatgaaatgacgattacgaaaataaagggaaaaatacagctaagagtaaataagattagtaatattgtgaaaaaccgttcgactggcagcgaaaagtacatctgccgttttaattttgatatcattttgattcctcctaaaatagtgctgaactaggatctaacttgttgactatcttattagtaatcaaaatcaagacaaagccaactgctgactgatataatcccgctgccgtagacattccgatatctccgctattcattaatccacggtagacataagtatctaatacattcgtcacatcataaagagcccccgaatttcttggcaattgataaaacaatccaaaatcagctcgaaaaatactaccaacagacaaaatcaacataatgacaataatcgatcttaaatgtggcaagactacattccttatctgttgccatttactggcaccatcaactaaagcagcttcataataactagtatcgatccccataattgacgcgtaataaatgatggatccatagcctacgcctttccataaactcgtaaaaacaataataaaaggccagtacttcggttcactataccaatttatgggttccacaccaaaattgcttagtaaaatattaattaatcctttatccgtactcaaaaatgcgtaaacaaagtaactgatgactacccatgataaaaaattaggaaaaatcataaatgtctgcatctttttcaataaccgtttgttcgccatttggctcagaatgattgctaatgacactgtacaaaaagtacttagcaaaatacctacaacgttataaacaaccgtattgcgagtaatgatccaagcatcttgcgaagcaaagagatatttgaaattttcccagccaacccaaggactgttgaacaaacttgtaaagaatccccttgatgaaattctgaaatctttaaaagcgattacaactccaaacattggtatatagcaaaatataaataaccataacgcacctggtaaaagcataataaacaatgctcggtttttttttagatttcctaataaccctttctttagcttcattttgtctctcctctctcagcgtttccttgattatacccacttggttaatcgcttacattaattttttatacattatttttagtttattaaacctctacaatagaatagtttttaaacggaaactgtattcacaatcataagtagccctgtttgcaaagcgtttacatcacttgtaatatgtgctataatgattcataaaattagagattatcaaaatgaggactttgaatgaaaaacgatttatcaaaagttattatgcgttttacatacatattgattttttttattactttacttgcctgtttcacattgttcttttcctatatcaatgtgattgaaaaagaaaaaaatcaaaacctgcaaaacattcagcaaatcacccactatatggaaacatataatcgtattctctccggtatcgtgacagagatctatcaaaattatgatctccaagaaaaccttaatgactactacctctcatcacctgctgaatacatggaagatattttgtcaaaggatcgctcccctacctatttagtagataacttaaaaaaacttgtgcaagatgatgaagttaaaaatatatctatctcattagattacgaaaaatacttaagtgcctacgcacctacaaaaaacgaaaaaatttcttttattcgttcattaagtttcattagtgaggacatgcccgatgctacattgattctagacgtttcgatcaacgcgctaaaaaagagtctctttccaacacattacaattattctttgtctaatggtattgattccgtcaatttatctgaagacatctcgccttctaaatggaaaaaaacgcaacagatagctatcggtaaccacacattacaagtatatgaaaatccaaattattcgtcacaaaccttattaggtctggcaatcatgattttcttattaatgagtttgtttattcttgctattcatcaattattaaatagaagttttcgtaactatatccagcagtatcaggaaatcattacttccttaaatcattcatctacaggagactacaagtcaatcaatatcgaaaacaaagtcggtgatttgaaagaaatcgctatgcatatcaatcagttttatttagataatgctacatatcaaaaaacactttatgaaaataattggttgaagcaagaagcaaagtatgcagcacttcaatatcaaatcgagcctcattttctatttaataatttggaatttattcgaatgactgccatattgaatgatgacgaagaaatcagcgacagtatatatttattgagcaagttgtatcgcaataatacatatcagcccgacataattgatttgaaagaggaattaattaatatcgacctctccttgcaactacatcaacgtcgttatcgacataactttgactatcagctgattgatcatattgatcaattaatgttaccaaaactttctttacagccatttgttgaaaattatattaaacacggcttcgattcatcaaaaaaggaaaatcgtttgactgtctatgcaactgaaacaaccaaccattatgtgttaaaaatcgttgaaaatgggaaaggaatggaccaagacaagctggagcatattcaacaaaaacttaatgatgatattccttatagtgagaatatcggcatctcaaattcttttcgacgtataaagcatctctatcctggagatacacgttttgttatagaaagccaactacacgtcggaacaacgattactatcaaaatacaaaaaggggggaatatgcatgttgagaattgcaattgttgacgatgattgtacaattgtagaaggcataaggcattatcttttgaagaaagtccccgacatcattatcgatcactgctacacagacggagacgaagcatttaaaaacctgcaaaaccagcgctttgatttacttatcacagatattacgatggggaaaatttctggactcgaattaatcgaatctttgcaacaaacatccaatcgctactttactagtattgtcattagtgcccaccaaaattttcagtatgcaaaaaaggggatgatttatctattaaaagttacataacgaaacccattgattttccttatttagttaagttagtacaagaagaaaaaatgcgtaaatcagcagctaatcaaaactctctaactgatgattcttttaatgagtcaattcaacaagtgattgattacgttcaaaacaattatagtgaaaagcttacgctcaaagatgtagctacacaattccattaccatcccgcttatttaggacgggccttcaaaaaagaaacaggttattcctttcatgattacttgctagactttcgaatcaaaagagcaagtgctctactgaaagacacattcttatctattgatgaaattagtcaaaaagtaggaatagatcacgtgagctatttttctgttctcttcaaaaaaactactggacacagccccagtaattaccgtaaaaagcttctataatttctcagacgtgttcatcttctagttatacttatacaacaaggagccattgaaaagtggtgatttttggctattaaccatttaatgatggtagagaaaaatacattagaatatttaatcagatccagttgagcataacgcataggattttccttatgtcttcaacccccgctgaggttgaggaatatggaaaaaactactatgcaagtcgagtgcaaaaatggcgctgaactatttaactgaaatgaaaaaggctattttagaagatagaatagatggatgtagttatttaaataggctcttcgtcaaatcgtgttggtgaagacaaatttgaataaaacttagtccgatatgcggcgcgttctgtgcgccgcatatttttttagttttcaaagatcagaccttgttgtaaatagatccgtgcccgaaagttataaaagttgcgataaccaaacgcaattcgtttaatcagcttgatcttgttattcagcccctcagtgacgccgtttgagtgggacaccttaaaggcatttgaaatacccgattggtagcgatggaagatcgtgaatttctttttaaacgactgaggtaacgtagatgaaattgttttaagggtttcttgaaagccttccgtacctcgtttaacgaaataatagcgtaataattgacaaaaatgatacgcagttcgcaattcttcgttgtagcttaacagctcatcaacgatttctgtttgactaattggtcgtttaaacagtcgatgataatgccgtttgagtggctccaatgtcgtggaatctttgagtaagagtttccaatatcgcttgagccgacggtacttcttctgattttcagagtgtgaggttcgaaaacgattcatgatctggacacgtaattgattgaagctgcgattgatgtgttggacaatatgaaagcggtcagttacgatctccgcatttggaaagactgttttaagcaactgacaatagctggcattcatgtccatcactaggtacttgacctttaaacgggcttttctaggaaagcgcaggaagtattgagttagtttgtaaagtctgcgatcttcaaggatcgtaaatagctgatgggttgtcccatcaacacaaataaaactcatggaaccagaaacagacttcattgatttgaactcatccatacacaacaccgtcggaaggaagttcatacgtggctggtaatgcttcgttgcttcacgcaagatccgtgtcaccgtcccatccgagacgaagtacttcttagcgattagtttacgtgattgattttcgtacagttccatgagaatcgcctgcttcagttcctttgttagttgatgatgttcatcaactaagtccgttttcgcagaaaaggtctgcccacaatcatagcatagaaaacgggtacgttttaattctaaaatagtcaacttttctttgactttcaatatctgagtacgtgtcgtataggaaccgttgcggataatacgaatcgatccacagtgttcacaatgggaaggtgagtcatccaatctccctttaataaactgcgcttgaacgcctttatattctttttcaatcagccattcttcatcaaaaaataaatgtttatctgttaatccgagtaattttctagtatgattatccattgagagactcctttggtaggatgacgttttggtcgactaaattttaccaaaagtgagtctctttttgagttgaaacgaagaaaaagtgttagtagaaaatcgccttcgattttccaccaacacaaaatattatagaaccaaaatcaattctaccttagatgttcttatatcactctatcagtcctatttgacaaagagccaagaaaaagacgttggtcgtcgatgctgttctctcgcctactcctcgtgcttgtagaagttgtggttctactgtggtagatggaaacgggaaagcaattatagtgaaaaatgggaagaaggaaacgattgtccgttttgaacaatacaatcatatgcctttggttacgcgcctaaaaaagcaacgctatacctgtaaaaactgtcgtacccattggacggctcaaagttattttgtccgactcagccattcaatcgcagatcatgttcgatataaaattgcttctttactgactgaaaaagtatctttgtcttttattgcgaaaagttgtcaggtatctttgactaccgttattcgtacattgaaagagtttaaaagctatttaccaaagccttctaagaagattctccccagagtattgatggttgatgaatttcgttcgcacgcttccatagaagataaaatgagctttatttgcgcagatggtgaaacaggaaacttaattgctgtcttgcctacgcgtaaattacctcgattaacaagctatttcttaggctgcaccaatccagaagaagtagaattcttagtcacagacatgaacgccgcttacttccagcttaccaaacgtgttctgccaaatgcgaaagtagtgattgatcggtttcatattgtcaaacacatgaatcaggcactcaatgagttgcgtatccgtgaaatgaatgagcttcgtaaagcaggacagaaaagtcaggcagaaaaactgaaaaagaactggcgctttctgctaaaaaatcgtgcaagcatcaaccattatgagtacaaaacatggaaaagtttccgagcaccaaaatacccatttctcactgaagcaatgatgattgatcgattgcttgagttttctgcgcctctaaaggaggcgtatcccttttttcatgaattagtcgaagcctttcgagacaaagaccctgacttatttttctccttattggcagaacttcccgaaacgttagatgacggctttcgggagaagcttcaaaaccttctgacctatgaagaaggtatcaccaacgcaatgatctatccttattccaatggaaaaattgaagcgaagaatacccacataaagacaatgaaacgagtatcctacggatttaaatcattcgagaacatgagaattagaatctttttgatcaatcaattaatcaatgtaagataacaaaaaatggctctataatttatgggactgatgaatcagaattgattcttcagccccatttttattttaggtattaaaaaacatatcgttctctagtatgattaaatcacgacaaaataaacaactgagaggacgatatgctatatgaatgattctatcaaaaaaatgctgcgattaatagagaaagatttgatgattacagaggtctcttacgagacctttcagaagaaaaagacgttgatcgtcgatgctgttttctcacctgctccccatacctgtagaaattgtggttctactgtggtagatggaaacgggaaagtaattgtagtgaaaaatgggaagaaggaaacgattgtccgctttgaacaatacaatcacatgcctttggttacgcgcttaaaaaagcagcgctatacctgtaaaaactgtcgaacccattggacggctcaaagttattttgttcaacccagacattcaatcgcgaatcatgtcagatataaaattgcttctttactgactgaaaaagtatctttatcttttattgcgaaaaattgtcaggtatctttgaccaccgttattcgtacgttgaaagagtttaaaagctacttaccaaagcaatctaagaggattctccccagagtattgatggttgatgaatttcgttcgcacgcttccatagaagataaaatgagctttatttgcgcagatggcgaaacaggacaattaattgatgtcttgcctacgcgtaaattgcctcgattaacaagctatttcttaggctgcactaatcctgaagaagtaaaatttttagtcacagacatgaacgccgcctacttccagcttaccaaacgtattctgccaaatgcgaaagtagtgattgatcggtttcatattatcaaacacatgaatcaagcctttaatgagttgcgtatccgtgaaatgaatgaacttcgtaaagtaggacagaaaagtcaggcagaaaaactgaaaaagaactggcgctttttgctaaaaaatcgtgcaaacatcaaccattatgaatacaaaacatggaaaagttttcgagcaccaaaatacccatttcttacggaagcgatgatgattgatcgattgcttggcttttctacgtccctgaaggaggcgtatccctattttcatgaattagttgaagcctttcgagacaaagaccctgacttatttttctccttattggcagaacttcccgaaacgttagatgacggctttcgggaaaagctccaaaaccttctgacctatgaagaaggcatcaccaacgcgatgatctatccttacaccaatggaaaaatagaagcgaagaatacccatataaagacaatgaaacgagtatcctacggatttaaatcatttgagaacatgagaattagaatctttttgatcaatcaattaatcaaagtaagataacaaaaaatctgagccagaatgaggttcattctgacccagatttgattttgtacaacccatcagtccttattgacaaagagcccttctttttagtattattataattcttccatgcgttcttccagtcgctgtaaatcgcttggacttaattccccaatttttttccatttgacctttttgttgtttttgggtaattcgtttagagttcctacgtcaatccaagattctttttttagtcctgcctgtttccaatcccttatttcaacgtatttcagctttattttatcggatttagtatgatattttgaagtaattgacagaaacgaaattgtgtccagtccattttttagaatatagacaggccggcgtttaccgccctctgcagctgtgaaagcaacgtagacggttgctatatcattagtattcatcttcattgaaccactcttcaattttttcgtcagtgtctagtttttggacaggcaatttttccgctaatctttgaatattatggattcgtttacttttttccgacaattcaatagaaaatgggatttttccttgctcaacaatttgcttataaaaaacggtgacggctgttttggggctcatgcctagttcatcaataatgctttctgcttcatttttcaatttttcgtccatagaaatttgtaacttagccattttctccacctctttctgacaaacacattatatcacggaaagagttcaaatggaattaatacaactacttttgaactccttgaaatgcagtgtatttatctaaatataaggaaaggatatagtgctaaatggccttgatagatagaaaagtttcaaaatccgccacagcgataattgaagcgaacactcaacgacacacagaacaggaaaagactcctaaaagaaccaaattaactaggacgtgtctgaaaactccacaaagatgtggtatgctctggtaaaaaacgaatggcacaaccacgaagaccgatatggttcttggaaaactttctccaccctttttgtaattggagggatagtggtttattgatagcgattttccaagttcttcaagtggaaccagacattgagcaccacggctaaaaagtgaatgaagtctttatttttaatcaataatttttaatgattaccagtaattggttttttcatgcgccctatttctatttgatgtggagttaaataatgctgataagtaaaaatttttccgtcaattaaactgccactagtgaatcctgttctattggtaaaaagagaatagtctgggtattcatctacaccaaatgataaagattcagccataaactgttttttatcagcaaattcagcactgctaccttgatggatatggcctacaaaaatacctaaaatatcactttcggcaatcaattcagcaaaaccttccggaacttcagttacaatagatggatcttcccacgacaatggatgatgaaccaataaaatcgttcccttttcagcaggtgtacccaaccactcttgtaattgaatcatctgtcctatcgatatttttccttcgtgctgggtatcttgagcagaatccaaggaaataattcgtaacccattttgattcgtacaatggatatactctcccgtttcattgctttcaacactcattccttcaaagaaaacactgcgacgatcatgattcccacgacaaaaatagtaaggtgtggttgggaaatattgatccaacattttccgtaagacttgataatcagaaatccccccttcatgtactaaatcacctgttaatagaataaaatcgtacactgttaacgagagttcttgtaacaatttttccaatgccaactgtggatttttaattgttggaaatagttcagcagtaaacaagttagtttgatagttttctctaaaatggatatcagagagatgcaaaaagcgcatggctattccctctttcttcaataaaataatcaggatatcctaaattttcttgcgtctgataatcaaaaaaatgcattctttcaggttctatgcggagattgactgcatcaccaatctgccaagtaggtttttcattaaggacaatcatttctataccatcgactttaacggtgtacgcataactttgacctaatagctcacgatacttcacttgaccgtgtaaatcgcttgtttcttttgaaaaggttacgtgttctggtcttatgcctaaatacaatgagccactaacctgaagaagttgtttttgccaagctggattcaatgttaaaaattgactggctacctttaatgttccttgatcataagtaactggcataatattcatgcctggcgaaccaataaaatttgcagtaaaagtatttttaggtttcgtataaacatttttcggcgtatcaatcatctgaattctaccttcattcaataaaacaatccggtcagctaacgtcatcgcttcaatttgatcatgagtgacgtagacaaaagtttgtttataacgttgatgaatttttaccaattcttttcgtgcatccaatcgtaaacgcacatccaaatttgataacggttcatctaataaaaaataattactccgtttaaccaccgcacgagccaatgctacacgctgccgttgccctcctgacaaatctttaggaagtcgatcttggtatggcgttaaacctaacatcttcaaagcttcttccaaacggtgctgaatgtcagctgtcttaattttattcgcccttaatgcaaaaataatattctcctttacagtcatgtgaggatataaagcataattttgaaaaaccattgcgatctctcgttctccacaaggtagcttatttgctagttgtgtacctaaaaaaagctctccactcgtaattttttccaaaccagcaatcattctcagcaaagtagattttcctgaaccagatggtcccagtaacacaattcgttctccagcggccacagctaaatcaatttcttttaaaatggtatgttctccatatttttttccgatatttcttaattcaagcgtttctcccatgatttgtcctccaatttatttaatacctgcagaaacaaaagtcccgataatatatttttgaaaaattgcatacaagactaacggtacaaacattgtaattaaactaatcgccattgctacggtaaaatttgtcccaccttcagaactaatataggtctgcatcgccaacggcaaagtataattatctactgtccgtaaaattaataccggccaaacatactcattccaagaggtaataaaaaaccaaataccggtagaagtaatcgcatgtctagtaagaggaaaaacaattttactcatgacggttgtttgtttgatgttatccaatgccgccacatctagaaggctcactggaatttcccgcattgtttgcgtcaataaaaaaatgcccatcgcatcagcaaattgtggtattatcacaccccaagtagtatcaattaaattaagttttgcaatcaacaaataattaggaatcatcgcaacagtaaaaggaatgaacatcgtaccaatgatgataaagtaccagattttcttccctttgattcggcaataagtaaaactatatgccgcaaaaaaagctacgcctaacttaacaaccgttataattgtagcaataaaaaaagtatttctcgtaattttgataattggaagattttcgaacaaatagcaaaaattttccaaggtaaacggctgtggtatcaaactagtaatcgtctgataggcatctttcaatggcttaaaagaattggccataataaacaataatggatagataataatgattatgatgaacataaataagagatgtggcaaccagcgtttaattttcatagtaaacccccttttccacaaatttaaatattacccctaagaaaacagcaaatattaataaagttaaaactgaaattgctgaagattctccgactttatacatttcaaaagccttttgataagcataatagatcacgtttgcactaccattattcggtccaccacgagtgatgatcttaatcggagtaaacacatactgcagaccttgaacaatggtcatcaccaataaatatagtcctgtcgaactactcataggcaacacaattgtaaaaaaaatgcgccagatgggtacacgatccaacttagctgcttcgatcatctcttgatcaattcccacaattgctgcaaaaatgacaatgaaattataaccaaaaactttccaagcagtaatacctgcaatcacagcaattacccaaccttgtaaattcatccacataggcagtcttaaaccaaaatttcccaacaagacagcaattggtcccgataccggatttaatatccatgtaaaaaccatccccgccactaccaaagaaatcacagctggaataaaaaataatggtttatacaaattctgccctttttctataactattcctaataaaaaggatgtaatatatgggaacacacagctcagcaagacaaatagaacggtataggacaaagtattcttcaacactttatgaaagactggatcagtcagcacctttacatagttggcaaagccaacaaattctttagtgggggccaccatattccagtcaaaaaaactcaaatagatcgtataaatcaatggataaaaaacaaacacgcccaacaaaataattgctggcgccagatacaaataacctacatagcgcttcatttccgacagcctcctcatccttatgtcaaaagcagacgaccttgtttttcctttcttacaggcgctgtcgtctgcttgctttgcttatttgagtaactcattaatttccttttgagtagctttcatcgtttcattgacggaattacctgataaaattttatcccgcatatccaacaatttttgttcagcttctaatccagcatctccaggaaatgaactccaactgaccatcttatccatctgatcaattgctggtatcatcatctgattttcagctaagaaagcttttaatccattttgggcgtctgcaacatctttacgtggtggtaaataaccagtaccttctgtccatttagctaaagattcaacactataaagatattttaagaaatcccaagttgcttcctttttcttatccgtttgtgatgtaacagctaacattgcgccaccagcaggtagtttaacttttttcccttcccaacttggtgactcaactgctttagcagtaaaagtactatttttttgaatgttgtccctttgagcaatagtggtatagaccatcgcgacgttaccatcaataaagctttgcacaccttgttcccacgtagtgtgtaatgccgtctggtcttttaccatcctttgatataattcataagcagcgataccatctttagaagcaaaggtagctttgccatcttttattacacttgccccattactttctaaaattgcttgttgtgcccaattatcagcaggttcttgaatatacacgccatactttccagttttttcttttattatcttagaaaaagtttgaacttcttcccaagtttttggaccattttcatccaagcccgctgcttttaatatatcttgatttaaatataaaaccggattactaatggagtaaggaatacccacttgtttaccatctttttcagacagtgccatgatattgtctaaaaaatgatctttaaaataatcagcattatccggatccacttcttctactaaagattgaggattagtatatttgaaattttctgcaaaataatctttaaaagcccatcccacttgtactacgtccggtatttctttggaggcaacagaagcttgtaaattttgcatcaagcctttatacatatcaggattatattttgctacaaccttcactttgtcttgagattgattgtatttatctactaattcattcactgtttttccacctagggtatccgcattaacatgccaatactctatcgttacacgaccctccgatttttttgttatcttggtattcccactaccacaagctgccaaagagatgacacttaaaacagacacaacccctataacaagatttttctttaacataacattaacttcctcctaatttctttatggccatttttctaatcaagaaatattatgaactaccaatgtaaatttctagttaattttctgtaaataattcgaaatttgtgcatttcggggtacagggtcactggacatatccatcaagctaagaataaagcccccatatggtcatgtatcccatctccaaatctcttaactcctctgttttgattataaaatagtttattctgtgctcctttcttccataaataggcccatgcacaacgtgaggttatattataaacaccacagcgcgcaaggtactcaatcgtttctagttcattgactgtccatacagaaaatgtcaatcctagctgctgccccacttcacgggccaacttagttaaccatccttcatgaatattgacgatttgaacgctttgataggctaatttctgtaaggtatcgatcaaatctgcttcggtaatatccccaagttttttcccttcgaactgattttcaatattataaaatatatgctttccccaaatcgcagcccaagataattgtacatagccactaagaacaatttgtggccagatttgataggtttgtgccagcgaaaaaacggccatttccaatccctcttcttttaaatcacagttaatggtcatggttgccttctcattggccactgcttgaaacacctgctcaagggttaccgaatctgggacaacttcttacctgtcatgggctagtattagcgtaccatctgtttgctgacgcacatctacttcaaaacaaagctggcgatccaaacaaaagcgaagaaatgcccagctattctcctccgtattgtcactaccagagtgtgcagtgatcatggtcattttgacccctcctttaattccgtgattttctcccacacgtccactataccgatgaagcgttaatttcttgttaatttcttgtaaattccctgcgttttttcagtaaactagttgtaaatcttgcatgctccttcctacgaactcatgaatcgtcgattttgcccttctagctagtttcaccaattaagtagttctacattccccgcttttaacctactacacctttttttgttttcagctattccttcttcttgctgaaagtccttgaggttctttcttacaggataccatcaaggtgttcaatggcttattcccattgaatgaccgagacttactatcagatttctgctcgttgaaccaagtctttgatacaggatttcttccgtcatcttctcacaaataccaccttgcgtttctctagcgattggtcgatgtgcaccctcccagtggactgtcactacccctttttgctatgcctagcccacaaaaaaagctgtcctcacagacagccagactgtagacaaaagctgttccaaactcgtaactcgagcttggaatagctttttatctacttcgtttcgaatttttgaacaaaaaaaaaggctccttgcctttccatagccaggtggctaatttctttaaattcattgcagcaaacactagcatcgtatgcgtcgcgactttttccaagcctcgatacttggtccaacgcatcccatgcttttcttttgcatccgcaaatattcgttcaatcgtttgtttccgttttttgtaaattgatttattcagatctgttaggcgaagatgttccacttcatccatcagatctccccaaacatgtctcgtgatgactcgttgatgattttacttttggtacattggtttagcagaggacagttcacacattcttttggattggatttgtattctcggtacccttctcgagtaaccgttgaaaaagcgagcatttgatcttgcggacaaatataacaatcaaaatactcgtcatagagaaactcatttttgataatagcccctttttccctttgggccttgaataaggcaaacaaggtcgaaggttcaaatgagtcaaaaagtgaacaaacttaggtgtcttatacccagcatcagcgacaacacaattgatttcaggaaaaagtctcttcgattgtttgacgagctgaaaggcgacttgactgtcatgaatatttccaggagtgatgattgtgctaagaataaatccattgtcgtcgcatgaagtatgggcagaataagcaaattgtttttctcgttcgcctttgacgtagtagccgctttccggatcagctttacttatttttctttctttcagcttcacttccttttctaagtccaaagtaaaagggcgttttccagcctctattcgttgacgattgatctcatcttctaattcatcctgataggctttcgcttcatcatgggtcatttctttcgtaaacttatgtttattggcgttagctttgatgtgggtagaatccagatacaaattatcctctgttacaaaacctgctttaactgcttgttctaaaatataggcaaaatatcctcaaacaccgtcgtttctctaaatcggcgaacataattctttccaaaagttgagaaatgggggattttctcctcgaaggagtagcctaaaaaccagcggtaagcgacattggtatcgacttccttaatggtttgtcgcatggaacggataccgaataaatactgaataaacaccaatttgatcagaatcactggatcgatacttgggcgacctaaatcggagtaagtggcttcgacgattggataaataaattcaaaatcaagcgcggcatcaatctttcgaacgagatgatcttgaggaactagatcatcaatcgtaagcatcgcaaattgatttctaccattcgtattgtttttagacatcatagctatcactccttgcattcgttttcataaatctattataaaagaaaagactgtagacatcatccataaaatggactttgtctacagtctgcgcattctcattagagaacactcccttttttgtgacttttctgaagctagagtgaatactttcaactgcattagtagtgtacatgatttttctaatggcgctgccataatcaaagagttgttcaacatgagaaaagtttcgtttgcatacatctactgcaccagaataatgagaccgccgattttgaaaactgtcaaaagcagcatgtgcagcgtttaaagaagaagcactgtagaattttttcatgtctcgacagacttccttataatccttacttgggaggtatcgtaacgcatttcgaacaagatgaacaatacagcgctgcacaatgacagaaggaaaaattgcttttgcgccttctttgagaccggaaacaccgtccatcgaaatgaaaaaaacatcttctacaccacgtactttcagttcatcaaatacttgcatccagcgatttttagattctgtttgattgagccataggcctaaaatctccttgtttcctttaagatcatagccaagaatggtgtacacagcatattctttagcttcatagttttcgcgtaaagtgacgtacatacaatcaacgaatagaaatgcataacacttggctaatggccgagcttgccattcttccaattcaggaaggacggcatccgtgatatcagaaatcatttcgtgggaaatatcaaagccgtaaatatcttcaacggttgcggcgatatcgcattgactcattcctcgtgcatacatggaaagaaccttaccttcgatgtcggagacatctcgttttctattaggaatcaactcaggttcaaaagaagcctcccggtctctgggaacatcaatgtttactttaccaaagctcgttttaagcgtcttattgccataaccgtttcgtcgattgtcatgtttctttggctctttagaatgggcgtcataccctaaatggttattcaattctccttgaagcattttttcaaataagggaccaaacacatcttttaaaacatcttgcatatcctctacagattcgggttgataagtattcaaaatggattcagctaacttctcagcatcaggatttcttttctttctagccatcgtgtaatcacctcttgatcttattttagaaaaataaaaaccgtgaagcaaccacccgcctaggattgatggttacttacacggtttatattacactctcatttttggtgctaaaaagcaccgaaaattttaattattgtcaattaataattcttttggattccttcttaatatattgaatgaagaaataatcaatgatacaagaagtactaaactcataaatataactacataaatcatgaatttaggtaatacattgatatctaaacttgataatgtcttgttaaatccttcagcttctgccccaccacctaattggctagatgcagattgtttagctatttgtttagctatatcaccagtaaccttattcaatatattattcccaagcttgtcagctgtatattgagctaagaaataggaaccaacgaatgcggggattgatataaataccatctcaattaggaattgaccaaaaatttctaattttgatatacctaatgatagtaatactgctatttctttctttctagcattcatccataagaataataataatgaaactacaactcctgcaaatattaatgagccaaaaaataatttatttgaaattgagtaaatacctgatatagattgttgtaatgcagggtaatttgatgaacttttaatcaaattatattctctccaatttatatctaatttcccaagatcttttattacactatcaagattcttatcaccttttacaaagaatgttgcatcttggtatacagctgtatcttcggtattaccataaactttagcagctgtatgaatatcagtgattaatgtattttcgtatagttcttgtgctgcacttactccaccgctattatgcccatcgaatagacctttaatttctacttctactgtttcatctgcacctttctcattatcagcatcaaataaattagattttatttttatcttatctccaactttaaggttatttttttcagctaaatctttatgcattaagattttatttttatcttcattttctaaatgctttccttctactaatttatatgcttctgatacaaattttgtttcttttgttgagtcgttaaccccagttaacataactgttcttttaaaattctttgctctttcaggtgattgattcgcaagagtctcttgagtttcaataatatcataatcaactaaatctgcaacactgtttattctttttacataggagtctatactatctgtttgagatatctttttaatatcttcaccttttacatttcccccacctctaggtgttcctggatttacttgtctatttatctccatagaaaaactatttgttatattagcaaatgtttcttttgaagctctgtccgtagcatctttaatagataaactaatgagacttaaagttgacatagataaaataactaatatgataattaatgattttaaactttttctagttacataagcaaatgcattttttatcattattcaacctccaaattcattttatttacttttttcaactttttaccacttagttctaaaatgatatccgcagaatctgctacttccttactatgtgttacaactattacacatttatttctatctttagctaatgtctttaatatattaattatttctccagcagtaacactgtctagattaccagtaggctcatcagctagtattattggagcatctgataccaatgctctagcaatagctactctttgttgctgtccaccagataatttcataacatttctttttatttgttttttatctaaacctagttcaaacaagatactttcatctgctgatttatttactaatctaatattttcaattggtgataaataatctattaaattatagttttgaaatactaaagatatattattttttctatgattactatatcctttattttgtatatcttcattcttaaacaatatttttcctgtttgaggtttatcaagtccagcaagtaaggaaagaagtgtagattttcctgttcctgactttcctactatcgcataaaacttcccaagttcaaatttttgatttactcctgacaaaactttttctttagaatttgcataactatatgctacattctttatttctaatatatccattattttctcctaacttatttttgataagatttctttaggcttcttgattaacattaatgaagaagcaaatacaactgataaaacaataatacttattaatattaaataactttgtccaagtgttgttatatttgacataaaactactattatttattaaacttccaccggaaatcattgaatcctctgagttaatgaatccatctacaattacttttagtaatacatttcctaaaaataaggaagatattatacttggtatcgatatgaatattaactcgaatataaattgcattataatttgtatcttagatgttccaatagataagaatatacctatttcataaattctttcccttaaccatagaatcaagattaatgaaagaacaaccatcccacctaacataatagaataagtcattacttttattatatattttattccactcactgactctaaagactcttcaaacgcattagaatctttttcaacaaaatactttgactcatcaattttaagctctttcaatttgtttaaggctaagtctgtagattctgcactaccagaatacattaaaattttatttgcaatttcattattttctgaattgtttaatatctcttggcttgttgaataatctacaaacaccatattttcactaaaatcagaagataatcctgtatatgtttcctgttttttaccagaaaagatccctataattttaaatttatgactttttatttttccacttttttcaatatctagtaattcaagatcaacttcatcacctaattttagattgttttgtttagcaaattcttcatgaacaataattgaattcttatcattttcttctatatttttaccttctttaattgtaaatactccactactaaataaaatatttcttttagtattatttgtagcttcgagtgaaacaacattcttaaattcgtcagataaatcttctctatttattctttgttctccgctaactactttagcatcttttagttttgctaatccatcatattgaattattttttcttcaatttcttttaatttttcaatatctttaaattgattaacattaaaatatttaccatctttttttgttattgatattgaagaattagaactttcatataaagccttttctatttcattgcttgatttcattattgttaaacaagaatacaagcaagaaagaactatagttaatatgataaaaattattaaagttctatttttctttcttgtaatatatgctatagcattttttatcactttcctaactactcctctctattttcttactccataactaattgcatccactggacaagcatttttacatcgtccacatctgatacactccagatgattgcaattctcaactgaatctttattcatttggcaaacttttttacattttccacaattaatacacttatccttatcctgaatcggctacactagactagacagaaaaaataaggtgtgtagaataataaaaaacacactggaggatttttcatgccaagacgtcaacgaagaacctattcaaaagaattcaaacaacaaatcgtcgatctctatctcgctggtaagccttgcgcaggaattattcgagagtatgagcttacgccttcttctttcgataaatggatgaagcaagcacaatcaacgggctcattcaaagaaagagacaacttaacaccagaacaagcagaattgatcgcactaagaaagaaaaataagcaactcgaaatggagaatgatattttaaagcaagcggcgctgatattcggacgaaaagacaagtaattgatgccaacaagcataaatattccatatcagcgatgtgcaaaattctaaatatttctcgtcagacctactattatcaagcgaaaccgatcgaaaatgagtccgacttagaagagatcgttcaggaagagtttattcgaaaccgaaaggcttacggtacccgaaaattgaagaagtgtttagcaaagcgtgggcttcaactcagtcggcgccggatcggtcgaatcatgaaacgccgcggattgacatctacctatacgatcgctcattttaaagggcaacgaacagcttgtaatgaagcgaaaacagcgaatgtattagatcggacctttacacaagaacagccattggaagccatcgttacggatcttacttatgttcgcgtgaggaaaaagtggcattatatctgcttaatacttgatttgtttaatcgagaaattattggttattcctgtggtgagaagaaagatgcctcattggtaaaagaagcctttggacggataccgtattctttaacagacgtcaagctttttcatacagaccgtggaaaggaatttgataaccaaaccattcatgagattctgaatggttttggaattactcgttcattgagtaggaagggttgtccgtatgataatgccgttgtggaatcaacctataaatctgtcaaagtagaattcgtgcatcaataccaatttgagacactggcacagctacgtctagaattgtttgattatgtgcattggtggaactatctacgcttacatggcacgttggcgtatgaaacaccgatccaaattcgacaacagagattggcgaagcgaatccttgataatgagcgcggatctgatacctctggagaggcagcgtaattgaatgattgtgcttctgccggagaaaatcagatccgaggatgctcattgtcaagggcaatcgtagccataacaccgcagcattcacaacaccttataatttttgtcaaaaaaagtgttgccattccatctggcattaagaaaggatatgaagcctttgtcttttcatgtattaactttgacttttcaattgcttccttgttttcaccgttatcatcaacaggatctgtaacaactccaacgatatttacacccttgcttttcatttcattctgaacctcaaccaaatcaggaatttcctttacacaagctgtacaccaagttgcaaatacatttaccatagtaagatcatacttctcaaaatctttacttgtaaaatccttgccatttatgtcctttgttggtagtttacgtaaatctttagttaaatgcttctgtattttctaaatcagttttttctgatagcacaaaaccatttttaggacgttcttttttatctataatttgaatctcagttctttttaattcatccagaagattactttcagctccgctatttgtgcttaaatagcaatcgtattttccatcacttgaaactcctattttagtatgagtatcacattttataattttagatttttttcttctgatgtatttttttcaaatataccaatagtcccaattctttcaagctcattttgccaatttttatatccatcgcccatcttttctataactgcattcttttgttcttctgtcattttctcaaatgtcaaaatagcatactttagttctttatctataggactttgatcgtctaacatcgctatctttttatcagctatataatttctaaatttgtctgagagtttaaatttaagccctaaatattcataaacatattctttctttgcctccaatgtataatctgatggcttaaaagtttcatttttgccatttgcattaattgacatgccttcctcttcagaacttatggattgtccttcttttattttattgttttcattacttttttgacacccaactgcgcttaagctcaaacataatgcaagtaataggcatgctcctcttggtactattttttcataaattattcctcctttattttttacacaatagcattttatagctactttcaataacattctacacaccttttatgaaacgttgatgaaatataattttttatttttccaaactatggtataacaatataagtattatgcttaaagttgttcttacacgattagtatatgatcgattaatatatgagcaagcacagtaagtgtacggacacttacgaaaaaattgatgaagcagccctttgggatctgcttcatcaatttgaatcggctacactagactagacagaaaaaataaggtgtgtagaataataaaaaacacactggaggatttttcatgtcaaggcgtcaacgaagaacctattcaaaagaattcaaacaacaaatcgtcgatctctatctcgctggtaagcctcgcgcagaaattattcgagagtatgagcttacgccttcttctttcgataaatagatgaagcaagcacaatcaacgggctcattcaaagaaagagacaacttaacaccagaacaagcagaattgatcgcactaagaaagaaaaataagcaactcgaaatggagaatgatattttaaagcaagcggcgctgatattcggacgaaaagacaagtaattgatgccaacaagcataaatattccatatcagcgatgtgcaaaattctaaatatttctcgtcaaacctactattatcaagcgaaaccgatcgaaaatgagtccgacttagaagagatcgttcaggaagagtttattcgaaaccgaaaggcttacggtacccgaaaattgaagaagtgtttagcaaagcgtgggcttcaattcagtcggcgccggatcggtcgaatcatgaaacgccgcggattgacatctacctatacgatcgctcattttaaagggcaacgaacagcttgtaatgaagcgaaaacagcgaatgtattagatcggacctttacacaagaacagccattggaagccatcgttacggatcttacttatgttcgcgtggggaaaaagtggcattatatctgcttaatacttgatttgtttaatcgagaaattattggttattcctgtggcgagaagaaagatgcctcattggtaaaagaagcctttggacggataccgtattctttaacagacgtcaagctttttcatacagaccggggaaaggaatttgataaccaaaccattcatgagattctgaatggttttggaattactcgttcattgagtaggaagggttgtccgtatgataatgccgttgcggaatcaacccataaatctgtcaaagtagaattcgtgcatcaataccaatttgagacactggcacagctacgtctagaattgtttgattatgtgcattggtggaactatctacgcttacatggcacgttggcgtatgaaacaccgatccaaattcgacaacagagattggcgaagcgaatccttgataatgagcgcggatctgatacctctggagaggcagcgtaattgaatgattgtgcttctgccggagaaaatcagatccgaggatgctcattgtcaagggcaatcggagccataacaccgcagcattcacaacaccttataatttttgtcaaaaaaagtgttgccattccaaccaatctaatcgagtctttcaataagcaaattaaaagatacagccgtagaaaagagcagtttcaaaatgaagaatcactagaacgctttctagtcagcatttttgatacatacaatcaaaaatttctaaacagaagccataaaggttttcaacaggtaaccgatacattagtttcaatgtttactgagtaactaattattttgcaggaggacaatttatttacacaaaattattgacgctcccttaacaataaatgaagacttttttattgttaattgtttatttttctattattagatatgaaaatcgcatttagataaaatagaaaaatatgaatatattttaaatattaagatgagagtcattaacttatgatagtagtcaatttgcttttcactaattacaaaatatgtgatataggaagtttagttattgttctcataatgccatcctgtttttagattatctagtaatttttttgttatttaaaattaggagcagtgccaattgttttaattttaaaggcttttttatatcttctaaattagaagatatttgtatatcaatatggaatatattaccttttttgtatttttttatgttatctttagctaaaacatcaaatacatgtccttgaaattgtatcgaggcagctggatttagtttaaattgaggaaactttaccacagctgattcaaaacacttgtcacatttttttatttttttacctttcgccgtttgtataattaagcgagacaaataaaaaagccatttatgttacactcaaattgtaatacccgctaaagcatacaaggagagtgaacataaatgacttatacccatcttacaccaaacgagcttgtaatgatagaagcatattttcatcaagaaactccggttgctatcgttgcgaagcagcttaaacgtggacgccaaacaatttacaatgtctataactctctcaaatgtggtggaacagcacttgaatactttgaacaatacaaagaaaataagcgacgttgtgggagaaccgaaatcatttttcctgctgaggaaaaagaatacattgcaaaaagatcaactgaaggttggaccccagacgtcattattggccgtgcagagcgaaccttctcttgttcagtaagtaccctctatcgccggtttaagacgggagaattcaatgttttacatttaccgatgcaaggaaaacgaaaaccaaatggttataaggaaaaacgtggaaaacaggcattcaaaagaaatatttctgaacgtaaaaaagattatgtcgttttcgaagaagaatttggacatttagagggtgatacgattgtcggcatccaccataaaagtgccgtcatcacactcgttgagcgactttcaaaagccattatcgccttgaaaccagaaggccgtaaggcagttgatattgaaaattcgattaatgaatggcttcaatccgtacccaaaaatcttttcaaatcaattacctttgattgtggaaaagaattctctaattggaaaagtattagtaatacgaatgatattgatatttatttcgcagacccaggaacgccttcccaacggggattaaatgaacattcaaacggactcctccgaaaagatggactaccaaaagaaatggacttcaaccaagtcaatcaaggattcatctcatccgttgcgtccaaaagaaaccatatccctagaaaatcactaaattaccaaacaccattagaagtttttttgagttacgtaaatggaaagttttgtctcgcttaatttgacaaataatatttgtaaaaatattcgattgaatattctatttggcacgactcacttggcagtatatgtatgtcaatatttttcatctgtttcataggtatttcaaaatctaaactattaaaaacatataattccctgtaattatttacatctaactctactaaatttatctttggaacaatagatcctccacccattccaccataataaaaaaaatcttgttctctatcaaaatagcacatattaagctcagtttgtttatcatcctcaataattttataaatcaaacctatataatcatgaatgccggcaaaaattttttttaagtcaagttctaaatcttcttcgaaaacacatttaatttctcctactgataattgatactctatattacatgacttaattagttttttagatcccccctccagataggcatatgtttcaataattatgttctttttattgcttggcaaatttccgttatttattgcataaattaaaaatgactgtctatttagcccataatctaatacaacttcttcatactcatatttctttaaatatttaatatgaaaatatgctgaattaatcaaaactcgagtgttactgttgttatttattgttgttctattgtgtataaaattgtataggttgtcatattttcttggtttattaaaatcattctctacccgtggtgctagttaattttttcctagaggaaaatgtctaaacatgttggtaaatcaacaaaaaaacgcatatagtagtctcaaaactcccaagaaatgaggactacatatgcgttcatcaaaatatactgaacattatacagatacttttataacattcaaggaaattatgagaactgtttctaacatataccacaattgtgtaccagataagattaaaaaccgaagaaatactgatcaactgaagcaacgcgatacagtgattattgcttgtgttatatggggcataattaatggctatactagccaaagagccacgtatagagcggtttgttccgtcttatttcctaatggtgactttcctagtaggagtcgattcactcgcttaagttcaaacttagcttacactatcaagattattcgatactttttcatcaagaagctcaccaaaggtgaactagtcggaattatagatagttttcctagtccattatgtaaaccagttagaaatagacaagcaaaactattgaatcaaatagccaaagttggctataactcaacaaaaaaatcttatttttatggtcttaaaattcatatgatcgttactaagactggctttccgattacttactcaatcacgaatccaggtgtccatgacgtgaaagtgttagagactttatcggaagaagcgaatcttcccaatatcctaggggacaaaggatatattagccataaaatccatgaaaagcttgcccttaagggcattactatatccgttccgccacgtaaaaatatggataaatcagaaaaactagaccacagcttacttggaaaacaaagaaaaacagttgagactgttttttcttccttagaaaaattaggttgtcaaaatttcaactcacgttctgttaaagggctagagagtagatttgaaagcatattactggcttacagtgttctattaagtcgagcacaacgacgttttgaaggaactttgagatattctttaggatattaaaattaactagcaccacgggtattctctatataataatcattatcaactacaacattttgttctatctctggtattctattgtaaatgttactaaacgttttaaatacttccgaaaattcagttatcttcattaatctcaccttctaagttttcattatacacaaaaaatatatcctaatatctcaattagcctcccaatttaaaaccacgtaacgatgcccctatttcatcttcagttataccaatgtacctttttgtaattgcttgcgagctatgattaaaaataaacattaaggtagcaatgtctctagttttcttgtagtagtgatacccaaaagtttttcttaatgtatgtgttcctatatcatctcttcctaatttttctgctatatctgcatatatctgatagacacgatcccttgttatatgtcgaccttgttgccgacttggaaataaccaatcattttcttctttaccttcagtatataataaaatctcttctctcaaattatctataaaaatcggttttcgcttacctgttttatgttcaacaataataggcttacttttacctcgtatgtctccaacttttaatcctataatatctgacatacgtaacccattattgattccaaacaaaaataaaaaactatctctttctggattacttgttcttcttagccaaaactgaaaatcttgtatctcttcatttgtccttaacggttgtacattatagctcactattgtttcccttcttaaaaatattctgagttcatgattatatatatattttaccataatcatgaacttatatatatactctgttaaaagtgaagaaaatcaaggggtttagtttatgattttatatcatttcagtaactcagaatattccgacttttttgtacaaaaaaattaaccttacttatatgaagattctaagctcttatttaaattttagacgggcagttatccgtagaagttcttagaatagctaatttacataattaaattatatgaaatttaaatttgaacaatatactaagaactccccttactataaattgaaataaattagcatatgaataaccgtgctaccaagcttttcattaataaaatatttttattaacccgtggtgctagttaattttttcctagaggaaaatgtctaaacatgttggtaaatcaacaaaaaacgcatatagtagtctcaaaactcccaagaaatgaggactacatatgcgttcatcaaaatatactgaacattatacagactgtagacaaaagctgttccaaactcgtaactcgagcttggaacagctttttatctacttcgtttcgaatttttgaacaaaaaaataaaggctccttgcctttccatagccaggtggctaatttctttaaattcattgcagcaaacactagcatcgtatgcgtcgcgactttttccaagcctcgatacttggtccaacgcatcccatgcttttcttttgcatccgcaaatattcgttcaatcgtttgtttccgttttttgtaaattgatttattcagatctgttaggcgaagatgttccacttcatccatcagatctccccaaacatgtctcgtgatgactcgttgatgatttttacttatggtacattggtttagcagaggacagttcacacattcttttggattggatttgtattctcggtacccttctcgagtaaccgttgaaaaagcgagcatttgatcttgcggacaaatataacaatcaaaatactcgtcatagagaaactcattttttgataatagcccctttttccctttgggccttgaataaggcaaacaaggtcgaaggttcaaatgagtcaaaaagtgaacaaacttaggtgtcttatacccagcatcagcgacaacacaattgatttcaggaaaaagtctcttcgattgtttgacgagctgaaaggcgacttgactgtcatgaatatttccaggagtgatgattgtgctaagaataaatccattgtcgtcgcatgaagtatgggcagaataagcaaattgtttttctcgttcgcctttgacgtagtagccgctttccggatcagctttacttatttttctttctttcagcttcacttccttttctaagtccaaagtaaaagggcgttttccagcctctattcgttgacgattgatctcatcttctaattcatcctgataggctttcgcttcatcatgggtcatttctttcgtaaacttatgtttattggcgttagctttgatgtgggtagaatccagatacaaattatcctctgttacaaaacctgctttaactgcttgttctaaaatataggcaaaaatatcctcaaacaccgtcgtttctctaaatcggcgaacataattctttccaaaagttgagaaatgggggattttctcctcgaaggagtagcctaaaaaccagcggtaagcgacattggtatcgacttccttaatggtttgtcgcatggaacggataccgaataaatactgaataaacaccaatttgatcagaatcactggatcgatacttgggcgacctaaatcggagtaagtggcttcgacgattggataaataaattcaaaatcaagcgcggcatcaatctttcgaacgagatgatcttgaggaactagatcatcaatcgtaagcatcgcaaattgatttctaccattcgtattgtttttagacatcatagctatcactccttgcattcgttttcataaatctattataaaagaaaagactgtagacatcatccataaaatggactttgtctacagtctggaaaaattaggttgtcaaaatttcaactcacgttctgttaaagggctagagagtagatttgaaagcatattactggcttacagtgttctattaagtcgagcacaacgacgttttgaaggaactttgagatattctttaggatattaaaattaactagcaccacgggtagtagtatgttaatttatactaaattaaataaagtactacctttaataggtagtactttattatcaagccatcattccttcttctactagttctttttgtcacataattttgcaatcaataaatgttgcgcaataagtataagaattccattttctaaatttgaaaggtgatccataatttcatgttcaagtagtttattaattgtccacttgtcgcttcatctaaaaattttataggttttaggaatgctattcgcttattttaggaagattttaactgtttgctatagatatatatcatactagtatcgtaataaaagtactctaaaagaagaattttcaaatacgcaaaattaagtacgaaagagttgaaacaaatttggagaaaaatgagcatagaatgtctgatgagttaaatagacctaaaaattatctaaaagtggagcaaaattaggaattacaaacaaaacactaaattagtttatataattttggataggctacaattaactagacagaaaaattaaggtgtgtagactagaagaaaatataccaggaggaatttttatgtctaagagaacacgaagaactttttcacaagaattcaagcaacaaatcgtcaatctttacttagctggaaagccacgtgtagaaatcattcgagaatatgaactaacggcttcagcatttgacaaatgggtaaagcaatctaaaacgagtggttcattcaaagaaaaagataatcttacgcctgaacaaaaagaattgttagaactacgtaaaagaaaccagcaattagaaatggaaaatgatattttaaagcaagcagcgctgatattcggacgaagagacaagtaatcgatgcgaataagcatctttaccctatatcagcgatgtgcagaatattaggtctatcacgtcagtcctattattatcaatcaaaaccaaagaaagacgaatcagaacttgaagaagtagtcgctgaagaatttatccgcagccgaaaggcctacggctcaagaaaaataaaaaaagccttatcaaaacgaggcattcagatcagccgacgaaaaattagtagaatcatgaaaaatagaggattaaaatcgagctatactgttgcttattttaaagtacatcattctacttgcaatgaagccaaaacgacaaacgtattgaatcgtaaattcttaagagacaacccattagaagcgatcgtaacagacttgacttatgtacgagtcgggaaaaaatggaattatgtctgtttcattttggatctgttcaatcgagaaattctcggctattcttgtggagaacataaagatgccgttctagtaaaaaaagcatttagccgtatcaaacaacctctgacagaggttgagatttttcatactgatcgtggaaaagagtttgataaccaagctattgatgaattattaacaacttttgacatcaatcgatcattgagtcataaaggctgtccttttgataatgccgtagctgaatcaacttataagtcgttgaaagtagaatttgtctatcaatacacatttgaaaccttacaacaattggatttggagttatttgactatgtcaattggtggaaccaccttcggttgcacggtacacttggctacgagacaccggttggttaccgtaaccagagattggcgcagcgaatccttgataatgagctcggatgtgctaacgctagcgaggtagtctaactttaactgttagctcctgccgaagatcgtcacatccgaggaggctcattgtcaaggacaatcggaatagcatacggaaagaagttctgcaccttataaaatttgtcaaaaaaactgttgccattccatacatctttcagcattttactatatttggtatatagtgctaaggttcatattcgattgacaagagaatataaattgatctatttctatttcctaagttgagtaaacataactttgccctttataaatatcttccctctctctcttctctctatattttatatttgaataatcatatcaaggtattccaacgaaatgccaatggatttcgaagcttttataactttaaattacggatcatgatttggcatggggaatcattactaataaaataaaaaaatgaacagaaagaaaaggctctttgtcaaatgatgttggtaaagagaaatcttagaataatttggacagaacagaaagaagaaaacctctttctgttctgtttatttggttaaaaatgttttgccatgacgaatcataattcgtagtttgaaattgtaaaagttgcgaaagccgtacgcattgcgttttaatactttgatgtggttgtttaagcattccaatggtccgtttgaatagctgtagtgaagcgcattttggatctgtggcagaaactttttaaacgttcgtaaagtggttgtataggtttctggcagaccgctaatgtctctagttaaacaatcctcagatagtgactgatctcttttctttaccgcataaagaatgtcttggtataactgatagccttggcgtaagttgggacaagcagctaacagtcgatcggcaatctcactttcagtcaaataatctttaaaactggcacgccaaacccgtttttcatagtttaacttagcttcttctttttgtaggagtttccaatagcgcttcaattttttccctaaccctcgttgagagtgggaatttcctttaagtcgtaccgtggtttctttcactcgatgattcaagaaagttctgccaatatgttggacgatgtggaaacgatcgatgatcaactgagcattcgggaaaagctttttcaccaacgaaacataaggcgcatacatatcaataacaatcaattgaacggcttcacgagtcgctaatgaaaaccgagaaaaatagcgttctaaataaggcaagcgtcgattttcgacaatatccaataatgcatggctttgtccgtccatcatgataaaactcattgcactggcaacacttcgaaccgatttgaattcatcaaaccataagacctttggcaaagtctgtttgaaaggattcaatgggcggtagaatcgcttcatgacacgatagaccgaagaagtggaaatatttttctgacgagcgatttccgtcatggaagtattctcttttaagcgagcaatgacagaccaacgaactttttgactaatgaaacagtgtttttcagcaacagaggtatccgctacgaatgttctttggcaagacttacatttaaatcgttgtttcttcagctccagataagtgcgatactcagacacatcattcagtaacaaccgaacggttgtcgtcccccaacgaatgatcctagaggggacgacacaaagacaatgggaacactcttctggcttgtacagaagagttcctttgtaaatcaagcaaatttgccctttgtatttttctttagttaaacaattttcctcgaaatagatatttaggtctagaatatttagggtatctttgataagctgagtatgagacatcttgaatcctcctatgaattggtagccaaattaattctaaaggatttcagggtgtcttttctatattttttttatacaaaaaagatgttggtgaagttcaccaacatcaaaaagtatagagccaaagaaaacagttctttctgttcaccaacttcatttgacaaatatcctatttagcttattttatagctttttatatacacttttttaaaaagtgatttttccacatgaattcccatgagcaattcgaccattatctattattaaatcattgaactgatttttctccggaaaaacaactataacagaagtatctttaccagattttattattttgtcaaaatccacatcaaccaacgaggtttcaggagtaacctcatcattttcttgaacacaaatcgaaaaaggctctccttgtaattcaactgtatcaattccaatatgaatcaaataatcaatgcctgagttgctttttatattaatagcatgtttagtaggaaatatatttgttactcgaccagccaatggagcataaatttttgaaccatcaggtatgacggcaaaaccatcacctagtaatttttgtgaaaagacaggatcatttacttctgtgatggaaatgatttttccggaacaaggtgcataaagagtttcttgttttttctttttgaaaatttcaaacatattaaaaacctcctaattatcttttcctaatatttgattgatttcttgacttaataagtcagctttccctccaaaaacagcttggatgccacccttcacttcgaagacagcagttgcaccagtgtcttttattgtttgtttttgaataatctccccattcgtaacagcaacacgcaaacgagttgcacaagcttcaacagactcaatattttcttttccaccaagagcttcaataatgataagagactcttcatgtaatgatgtatttttgtttattactttttcagaatgaacttctgattcttcttccattccaggaatagctaccttaaattttttgataaagaatgtaaaaacaaagaaatatataaatgcccatgcaataccaaaaggaattaattttaaccaattagttttgtcattcccttgaagtacaccgaataataaaaagtcgatcaaaccacctgaaaaggaattccctacacgaatatttaagatatcagcaaaataaaaagataatccatctaagaatgcatgaatcacataaagccaaggagcaacaaataaaaacatatattcaactggttcagtaattccagttaaaaatgatgtaagggccccgctaaaataaagcccaccattctttttacgatttttcttaggaattgcacgatacattgcataacatgctgctggtaatccaaacatcattgttgcaaatcttcctgcaaaaaatctagtaccataagtaaacagaccagtgtggtttggatcagctagttgggcaaagaaaatattttgggctccagcaattgttgatccagctacagtttcggtaccacctaaagatgtataccagaacaaagggtaaatggtgtggtgtagtccaacagcacctgttaaacgcaataaaaaaccatataaaaaagttcctaaactacccatttgggcaatttgttcaccagcaactactaaaccattttgaattggtggccaaattaaataaaagaaagaaccaataatgattgcagctaaactagaaacaatcggaataaatcttgatcctccaaaaaaacctaagaattgtggtaattcaatttttctataacgattgtgtaaaaatgcaacagtaccaccaacaacaattgatcccactacacctgtatctagtgttgcatcttttgctgaaaaaagttcaagaaacccactaatagttgcagtatatactaaataagctactccaccagctaaaccagctgttcctttatctccatttgcaagtcctacagcaataccaattgcaaaaattagtgctaggtttgcaaaaactgcatttccagcataactcataatacttaaaattgtatgcaaccacggttgatctaaaaatggataagcatttatagcactctcatttgttaacgctcctcccagtcccaatagtaatccggctactggtaatatagcaattggtaacatgaaagcgcgtcctaattgtgaaaattttttaaacattttatttctccccctaacttaatgctttaacaaatcttgatgcaatttcctgtggtcgagtaatagcaccacccacaacaatacctgcaactcctattttttttatctcttttgcttgttctggagtatgaatccttccctcagcaattacacaaatcccttcttctaccaattttttaatcaaatctatatctggcccatcttgttttttactttcctcagtatatccacttaaagtagttcctacaaaatctattcctgctttatatgcatttttgccttcttcaaatgtagaaatatctgccataaataactgatgaggatatttttcttttattttagtaataaaagaatttatagatagtccatcatgtcgatttctaagagtgcaatcaagagcgattacctcaacaccggtttctactaattcatctacttctctcatagtggcagtaatgaatggagattctggtggataatctcttttaataattccaatcattggtaatgatacacactttctaatttcaataatatctcgaacagaatttgcacgtataccaactgctccagccctttgagcagccaaagcaaaataaggcattaaactttcttcctctttgtaaaatggttcaccaggtaatgcttgacaggaaacaatcaaaccttttgaaataagatctaaaaacctctttttatccattatcctaaacactccaattttttattatttttggataacaactccaaaaacaatatagcatccgctttcataaaagtaaagataaaaatggagtatttaggagttttttttattattttggagtataatggagaaaagttgaaattgtagaggagtttgtatgagttatatctatttaattaaagaaaattatccatttttaacgaagtctgaaaaaaaagtcgctgattttattttaaattctgggaaaactattatttatagtacgatgagtgatattaagaaaaacacaaaagttggcgatgctactattattcgcttttgtcaaaaaattggtttttctggtttttctgatttaaaaattgaaattgcaaaggaagactttagtcaaaaaaaagaacatccgactagtgtaaagtactatgatgaaattgctaatagtttaacagaagctctctattccactattaggcttttagacgaagaaaaattgaatgaagccattaaaatgatcactcaatcaaaaaacatatatatatttggagtgggatctagtggaaatactagtcttgatttagaaaatatgtttcttcgcgtaggagttcaagcaaaagctgtactagaccctcattttcaagcccaagtcgcttctttattaacagttaatgatttagtaatcattttttctttatctgggaaaacgaaagatacttatgattcattgaaaatagctaaaaaaaatggcgcaaaaattattgctataactaactatattcattcacctataggaaagtctgcagacttagttttacaaacagccattgaagaatttcttaatggtggatctttagctggaaaaatatcacaactttatatttgtgatctattagttcatggttatgaacaaaacaataatattgattcagttgaattaagagaaaaagttttgcgctctattattgataaaagtattgagtgaactacccccacttagctaaacctaacggtttttaacgattgaagtaggcaattcttgggatgagagcatacttgatagcttattttttactaatagcggtggctcttattgaccaaatatccctgtagttcctacggttcttgattttatctaaagatatttttatcgtggaagctattgatcaacttgaaagaaaaacgtgtagctcattatcactagtttatcgagtatggatgaagcaatggatcatcctctcttaaataaatttattaaggatctgatccttcaaattttttccatgatcgatgagcaggaacctactgaatctaaacgacatcgggcacaaggaattattaagattgctaagcgaatgttttctataaagggtgttctaagctatacagtgttaattcaaaagattcccaatcatcttgtttataagaacaacgttgaagattaaaaaagtgtttcaatgctaaaattgcaaaatacttcaatgttatgagacaaactgtctataagaatcaatttccacccatttcatcacttgttaaaaaacgagatgttttatcaacgtgactggaagaatacaacaatcaatcagtttataaacaaattggatgattatattcattggtataataatcaacgaattaagttatctttaggagggctaagccctcttcaatatcggaagaagcaaagatatatttgttaaaaaggtccaaaaaaatatccgcacccccttttttttgtaaaaaactattgcacaatacaagtggcctacggctatcgaaatttccataactttcgagcaagaatttatctcattcaaggcttgatcttccaagtaaaacaaaaacggctctataatttatgggactgatgaatcagaattgattcttcagccccatttttattttaggtattaaaaaacatatcgttctctagtatgattaaatcacgacaaaataaacaactgagaggacgatatgctatatgaatgattctatcaaaaaaatgctgcgattaatagagaaagatttgatgattacagaggtctcttacgagacctttcagaagaaaaagacgttgatcgtcgatgctgttttctcacctgctccccatacctgtagaaattgtggttctactgtggtagatggaaacgggaaagtaattgtagtgaaaaatgggaagaaggaaacgattgtccgctttgaacaatacaatcacatgcctttggttatgcgcttaaaaaagcagcgctatacctgtaaaaactgtcgaacccattggacggctcaaagttattttgttcaacccagacattcaatcgcgaatcatgtcagatataaaattgcttctttactgactgaaaaagtatctttatcttttattgcgaaaaattgtcaggtatctttgaccaccgttattcgtacgttgaaagagtttaaaagctacttaccaaagcaatctaagaggattctccccagagtattgatggttgatgaatttcgttcgcacgcttccatagaagataaaatgagctttatttgcgcagatggcgaaacaggacaattaattgatgtcttgcctacgcgtaaattgcctcgattaacaagctatttcttaggctgcactaatcctaaagaagtaaaatttttagtcacagacatgaacgccgcctacttccagcttaccaaacgtattctgccaaatgcgaaagtagtgattgatcggtttcatattatcaaacacatgaatcaagcctttaatgagttgcgtatccgtgaaatgaatgaacttcgtaaagtaggacagaaaagtcaggcagaaaaactgaaaaagaactggcgctttttgctaaaaaatcgtgcaaacatcaaccattatgaatacaaaacatggaaaagttttcgagcaccaaaatacccatttcttacggaagcgatgatgattgatcgattgcttggcttttctacgtccctgaaggaggcgtatccctattttcatgaattagttgaagcctttcgagacaaagaccctgacttatttttctccttattggcagaacttcccgaaacgttagatgacggctttcgggaaaagctccaaaaccttctgacctatgaagaaggcatcaccaacgcgatgatctatccttacaccaatggaaaaatagaagcgaagaatacccatataaagacaatgaaacgagtatcctacggatttaaatcatttgagaacatgagaattagaatctttttgatcaatcaattaatcaaagtaagataacaaaaaatctgagccagaatgaggttcattctgacccagatttgattttgtacaacccatcagtccttattgacaaagagccacaaaaaccagttaagcactctgcctaactggttatgactaaattttcagttgtatctttctctaccaacactaaatgtcgaagagccttttttcgtttatgaatgtaagaccgtttctcgagccaatgccaaacaaccgagcgttccagcgttgtcttctaatgctggggtcacgatatatttgcttaactcaggtgtttcgacatacccattgaccaattttgcaaatgcgtcgtggacgttttgcagcatatggcgttgtttcatcacaccaccgccaaaaatgatcacatctggagaaaacatcaaggttgtattgtaggcacattgagcaatataggaggcttcgatttcccaataaggatcatcttctgcaacctcttgtccttttttccctaagcgtttttcgatggcgggtccagcggccatcccttctaaacagttgccatgaaatggacagctgccagcaaagtcatcttttggatgagggacgacgagcatatgccccatttctggatgactaaacccttcgataaagcgcccttcttgtaagacaccgccgccaatacccgtaccgatcgtatagtaaacgacactgctcaatcctttgccactgccgaagacatactcaccataggcagccgcattgacatctgttgtccaagaaatcgggatcggaaattcttttttcatggtaccgatgaaatcaaaattttgccatgccaatttcggggtcgaggtaatgtacccataagtggcggaatcgcgatggatatcgataggcccaaatgagccaatcccaatccctgctaaatctgcttggtattgtttgaagaagtcaatgactaaaggcattgtttcctcaggtgtcgttgtcggaaagctcactctttccttgatcgtcatttcttcatcgccaatggcacacacaaattttgtgccgcctgcttcaattgcaccgtatagcatagacatttctccctttattttagaatgaaatcactaaataaatgactatatatcatatttaaattatttttttatttagtaacatgacaagtaaataactactattttttctttttgaatttttatcattttttaaaattctaataatttttcatacaattgatatatgaaaagattaaataaaatgttattctcaaatatttgattaatctatattatttcgtttgtcaaattaagctagacaaatcatctttacctacgtaactcaaaaatacttccaatggtgtgcgatagtgtaatgattttctaggaatatgatttcgttttgatgccaccgattggataaaggtttcggataccttattaaaatccatagctttatataagccatctttacgtaataagccattcgaatgttcatttagtcctcgttgagaaggtgttcctggatcagcgaaataaatcgaaatatcattggtattactaatctttttccaattcgagaactcttttccacaatcaaatgtgatggatttaaacaagtgtttcggtacagattgaaaccattgattcagtctattctcaatatctatagcttgcctaccagcgggtttcaaggtgatgatcactttagataatcgctcaactaacgtgatcaccgcacttttatgttttccaccgacaatggtgtcaccttctaggtgaccaaactcatgattgaactgtatataatcagttgttctatcctgaatcgaacggcgaaaagcttgttttcctcttttttctttatgtccgtttggttttcttttccctttcattggtaaatcgtgagggtcaaaggttttatctttaaacatccgatatagtgtacgtaccgaacaagcaataggaaactctgctcgaccaataaggacatctggagtccacccttgagccacctttttttgaatgtattcttgttgcccatctggtaacacaatcggacgtcttccgcagttacgtttgtttttcttatattgttcatagtagcttattgcgcttccaccagatttaagaaaacgatagacattataaatggtttgtcgagaacgttgtaccagatgggctacttttgaaacagagtgtgattgattgaaataagcttctatcattacgagttcagttggtgtaagatgggtataggtcatttgtactcactccttataattctttcgacggaactattttgagtgtagcacaaatgacttttttagttgtctagcttaattttacaatcggcgttattaaaaatcttaccaaatttttggataccatcattgatcgcttttttaacttgataatacggtcaatcagtgtcgtctccttcaaaatatcttggaaaatctctactaaataatcaaggatgaccaccgcaaacatatttgacggaacaagataaccataatggcaagcatcatcacttggacgaaaacctgaccaagtcatacccgttggtgcaactgtcgtttcccgtccgtgattgactaacgtatcttccggtcgatcatcaaaccgttgaaaagtgtagggtgagtcttgatggttctgttccgtttcaaaaaccgtcaggaccttctcgatccccctaataaagtcttcactaaattgatctgtacggccagtattctgatataacaaataagccagctggattggatagcaaagagaatcaatttcatactttcgttcccagacccaaggattcatttgtgtttcgtcatcctgatgccccgcattgttggcctcttcattaaaagcatttgcataaggatccaagttaatatagaagaattgtttttttactaaaccactaatcatatccgccaaatctggattatctttggcgatgactaaataaggccgaacttgggcagttgaatcccgcaaccacattgcgggaatatcgccagtcaacaaaaaagttgtgccatcttcatgtcgcttaaccgttgttaaaagagtattggcaaaggcagcattaatgtttgctgcccattgtgggtggtcattaccacaaagagtcgtgattttttccataaattgttgaacagagactggtatttctttgtaggtcatttttgtgcctctttattctttattggaactttaaacgttatgccatcaaacgtttgactaagtaatacgtatcaacgccacgaaacggcatgtctttgagttcgccatagatttcaaaattatttttttggtaaaacgccagcgcttgataacttctcgtcgaaagtagaagattaatgacttggttttttgccgcaattttttcgacttcttcgatcaactgacttcctagaccatccttttgatgtttcgggtcaatggctaataacgaaacgttcaagctttgatcgctgattttccctagcagaccgcctaccaattcagttcctgaataagcagccaaggccacagatttatcgattgtttgataatcagggaaaaaatgttcctgctgttgatccaagaccattaaaagaaactcagccaactgactagaatcttccgaattaagatctgtttttatctccatttttctacctacttttctttgactattcttgccaactagctaaataaatcatttttatttcctcaattgttggtaccaaaggattgttattggggctaccactggcaattgcatcatttgccattttatccaaagatgcaataaaagctgccttttcaataccaaaacttgcgtaattgggaacagctaatttctcaatcaagtcctgcaattcttgaaagaagcactctgccaactcctgatccgtaccttctttttcaggattaagatatttcgcaataccagccaactccgagatgattacaggttttgtgtaatcaatcaccgcctctaataaaatcgcattggaaatgccatgagggatatgatacagagcgccaacaggtcttgacatcccatgaatcaaggtaaccgaagcatttgaaaaggcaattcccgcttccattgctgcctgcgccaagttttcacgggctattaagttttccggctcgctataggcaatcggtaaattttccataatcaactttattgctgaaagtgaaaagagccttgtaataggctgggcttttttagaaatataactttctaaagcatgacataatgcatctagtccggttgctgctgtaactgatgctggacttgtacgactcatttgtggatcaacaatcgctgcataggataaaaaagcagcctgtttcatcatatatttaatatctttttgcgtatctgtgattacggtcacatctgtcacttcggagccagtcccggcagtcgtaggtattgcaattagaggcagtggattttgggcaatcagttggccactagcaaattcagcataggacccactattattgattaacacagccacagctttagcagtgtcgatacagctgccaccgcccaccgcaataatcgaatcataatcttcctgttggtaaaaagctaatgcttcagctacaatctggtccgttggctcgcggtcaacgccatcaaaaattttccaggtcagattttcctcttttaggctggcaagcacaccttccaaaaggttcaaagagacgattagtttatctgtaataatcaaagttttcaaaccaaggttaccagcgatttttcctgtttccttgattgcttgatcgccgtaaatgattttttgcggcaaagttagttgatacattttgacacctttctgggcttctcagtattgaaaggcccctgctagtttttcttctttttcagctaaaactttttcagtagaaccatctgcagtaacttcagcaatcccggtattccaccatgaatcgtatccatccgtcatagttttaggtaaaactttaatatggattaatgtactccggtcagactcagctatttcagctagagatttctcaagttcagacatattaccgacattataagcaaccgccccataagcttcggctatttttgcaaaatcaaccgtcatgatctcctcatgataatctgtcagttccgttccaaaagatggcatcccattgcccatttgtaaattattaatacatccatagcctgagttatcaaaaagtaagacattgatttttttcccatattgaatactggaaagtagctccgaatgcaacatatgaaaactaccatctccaacaaaagcaaaaacttctttatctggatgcgcaatcttggcaccataagcacccgctacctcatatcccatcgtagaatagccatactccatattataagagttaactgtcttcgctttccacagacgttgcatatcaccgggcaaagagccagccgccccaaccacgatactatccagcggcaaactttgattgattttgattaaagccgcggtttgagtcaattctgttgttagttgttgcgcataattggctaacttttctgcgccaaaatgatttttgatctccatctcaaaatcagcatcatggtagttcaaatttgccagacgctcccgttcattctgccaatccctagtaacactagttaacaggtcaccatattgcgtttgatataaatcatcaagctcagattcaatttgcaatagggccgttttggcatcagctaccactgaaacaccgttcattttgtagctttgcatccgcgaaacattgatatttaaaaaagtcgtttgatccttatcaaaagccgtttttgaggctgtcgtaaaatcggtgtagcgtgttcccaacccaatcactagatcagcttctttcacaagacgattggcaggtgcaccaccggtcacaccgacaccaccaaaattcaatggaaaatcagcaaccaccgttgattttcctgcctgggtttccactaaaggaatcttatgcttttccgaaaaacgtttaagagctgatccggcttctgaatacttcgccccgccacccacgataatcactggtttcagacttctttcaattaacttaaccgcctctgataattcacgatctgtagctaggcggcgatcaaaataatgaactttttcattgaaaaaatcctctgggtaatcgtaagcctccccttcgacatcttggggtaagcaaattgtaacgggacccgcggtcacaggatcagtcaaaacttcaaacgcccgggttaatgcgctcatcaattgttctgggcgctcaatccgatcccaataacgagaaagtggcttcaatgcatcatttgtcgtgattccttgaccgtgaaaatgttcgacttgctgcaggactggatctggttgacggcttgcaaaagtatctcccggcaataataatactggcaaattattagccaaggcagtgccagctactgtaacaagattcgcagcacccggtcccactgaagtcgttactgcaaaaatttgacggcgcagtttttcttttgcaaaggaaacagccgcctggcccattccctgttcattttttccttgatagatttccaaatgaccaggattttgtgacaaagcttgtcccaatcctaagacatttccgtggccaaagatatggaaaatacctttcacaaagggtagcttttgatcgtctacaatcaaaaactgttgattcaaatacttaaccaatgcctgggccgtggttaagcgtagcgttttaggcatgaactttctccccccagctttgttctgcaatgactgcctcaatttcggacacacttggcatagcttccgaagaactatgacgactaactactagcgctgacgaggcactagcgtactgtaaagcattctcaatcatttttccttgcatcaaagcaaacaagaaagcggccgcataagaatcacctgccccaaaggttttcaaaacctgtgctttataggcatatcctcgcgtaatcgtgccatctttttcataagcaaatgagccatcgaccccgtgtttaatcaggatcagttcaggcgtatattggaaaagtctttcaacagtttgttggttgttacccccaacactattttctaacacatcaaattcatcgcgggtaccaatcacaatgtgggctttttgtgctagcaaagtgtagtaaacggctgtttcagcagttgatccccacgtataaggacgataatccaattcaaaaatcacttttacatcatgtttgtgggcatattccaccgccaataacgctgcttctcttgacggactttgggctaaagctgttcctgaaatcaatagcatttcgctggcttcaatgtactcttccgaaacttcatcaggggttagatataagtcagccacatcttcacgatacatcaaaatactgcattctgatggactcttaatttcggtaaaagccagtccggatttatgtccttcctgatcaaaaatcatctgacttgaatcaacacccgcttttgacatgaagtctttaataaatcgaccgtgctgatcattagaaagttttccgatgaaacctactgtttcccctaacttggccaaaccaatcgcaatatttgccggagatcccccaacatattttttaaatgtttttgtttcttccattggttggttaatttctactgagttcaaatcaatacaggctctccctaaagctgtaatagcaaatttcttcattttaattttcttcctctctcatgacacgttttatttttctgaaaaactcttacgatcggttcttgatccattcgtgatcaggatcatcatagaaacgccacattttcgttggaccggccatgatatttagataataagaagtgtacccatctggtacgccaacaggatgatagccttttggaacgattaccacgtcttgattggaacaggacatggtttgatctaaaagacgatcatcggaataaatccgttgaaaaacaaacccttgtggtggattgatttcatgataataagtttcttctaagtaagactcttccggtaggcggttttgatcgtgtttatgaggtggatagctagaaaaattaccaccttctgtgtaaacttccacgactaaaagtttatcgctgattgtatcttgatcagacaagatcgtctgcacatagcgtttattttggtaagcaccccgtgattccaataagacatcctcaggcttgatcaatctatctggtagactttgatccgttttagaagcagcaatcaaaatacgcgctttcgtttctgccgtaactttgtatgaacgatttttaccaatataaacactgtgagtcggtattttatcaaaaactgaagttctcgttccaagcttagggtaggtttctccatttaaaatcgctacggacacttggccggaaagaacaacaacgcaactttcaagagcagcttcatggtaactaacctcaccgccagcttcgacatcgtaaatacttaattcaacatgctcaaggacgctattctctccggttatatattgaatcaactgaactttttcgttcactggaaataaaattggtttttgtaaaagattcattattttccctctttactaaaatcgggggccggtcacaaacaatcatctcgttatgactagccccggtttttttattatgctaaagaacccatcggatcccagggtggtaaaataactggttcctcttgatactttgccagttgctcttttgttaaatattttttgttaatcaccacctgatagacatattcctctagccaagcatcggtcatcatgaaaaagcctttataaccgatttcttcgccccagctattctggactttccaaatcgtcggctgatcattttgcaaatctactccgctgattaccatggcatgagtcaaaagactttgacagtattctaaacggtcctgtttatttgaagtaaaatcgacatcgaataaattatcaacagcatagatgtctgtggccataatccctagctttcggtcagtatattggccgatatcactaccaaaccagacggcttcatgatctttcagttgcttgattgtcaatgcttttaacgttgccatatctacattaagatatttaatcggttgtccttcgataatatttcccatcatcgctactgtgtaggtctggttgtacactttgtttttggaaggtgcatgaatgatcggaatataatcctttaaattcattaacaaatacttattggcaaattcttttggtgttagatttaatccagcgtgataatttccagcatcatcacgatacttcatatcaatcttttccggcggagccccgatacagattgccaacattcggtaaacttccgcgagcatttgggaagtcacttcatcaatgtctttttgtgaacaatcctcagccaccatttgacgcagtttttttgcatcaagtcgcaacttggcatttagatacttgttcatgtcagctgaactgcgactattttcggtttccggcatcgaataagatggaacaatcccatacttttcaatcaatgaaactagcatgtcccattgaccaccatcctcttggggcttagatagtagaaaatctaattcacgactgcccaactctaaatcagccgtctcaataatattcttatagaaaaagttggctttctctaacttgtcataaaaatatagataattttgcgaaagttcaaattcagcgatttccaacttctgactgatttgctgattcagtaaattgacaatcgcaaacagccaacagcgtcccgaatgatattgctgaggaatttttaaggtcggtacttcgattgaaaacacaaagggattctgacttttagctgagacattttctgccgattcaacaacaccatttcgaacaacacctaattctgctagtttatatttgggggttccttcgtagttactttttaacttttgacaaaattctgcagttatttccaatgctcttccctcatttcccaaaacgaattgttttaatttcatatggtgcaaatgtcaaactcggttgtttatcttttacttcgccaatatttctttccaacaggtccgtctcacgccaccaagttaaaccttcaattgtcaggtcaaccgtctgatcagtcccggcatattcatgggcccggataatccaaccattaccatcttcggcttttttaatcgtatcaattacgatagtcgcatcctgagttgtggtaatttgcggtaaagtgccaatactaccatttaaaacaagcggtttttcattgatttcccaagcttcttgaatggtctttccttcaataaagtcgccacgatgtggatacagactgtaggtaaaatggtgttggcccatatccgccgttggatcaggatgaattgctcctttcaacaaactcaaacgcattgtttggtccttaacgtcgcaaccatatttggaatcatttaagatgctgaccccaaaatcacgttgtgacatatccatccactgatgggcgacagtctcgaatttagccatttcccagctcgtattccagttattggcacgacgaacattcccgtactgaatatcataagttgcgtaagttgctctgacagcaacatcgaatttagcttttagcagctgttgccgctcttgccaatcaatatctgtcacaaaatcaatgcgacgagtatgaggatataatctcatctcttgtttaatggttgattcaccaaaacgataaataaattcgacacattgatataaagcattagcgggtttgacgataatttcttgtgctgctagttcttggaatttttcttgataataaatatcgatatcccaagcatcaaaattcatcggtttatcttcaaataattgcaggacattcccggttccgcttaaaacttctcgttttaactccttatcgaataccgaagtcaattgtccgcttttattccactggatcaaataaaagtctgtctcaatttgatttgaatccacaacagctactgtaggaatctgcgccatttcctgcttctcagtgacatgaatcattttttgaccaagagctggaacatttgaaattaatccataaagcacttcaccattagcgtatgtttcaattacctcaccagcttcatcaacataaacctgattatccaaaagaaatggtaattcagctaaaattgaacgctgccagtttgcaaagttacaaactgtttggctgtcacctactgactgcaatggtgctaataaactttgggcttctttaaaaagtccttccatttcaatccgatgatcttgataaacctctttaattgaagatcccgggataatatcgtggaattgattacgcaaaaccgtttcccacatattaaagatttcaactttgggataggcctcttgtcccttcatttccattaatgaaaagaggatttctaactggcgcaacaataattcactttggcggttcgcttttttgacataagcttgagaggtataggtgcctcgatgatattctaaatacaattcgccatcccaggtatgaacatattcatcagtatttttaaaggtctcttgcagccgatcgaagtaatccactgctttaccggtttgaactttcggtaagccaggaattttgtctaatttccgccgtttttccaacatatcacgattaacgccgcctccgccatcgccaaatccataagaaatcaacaactcatcattaatgtttttatctcgataagcattgtaaacgcctaaaacagtttcaggttctaactcaccattataggtatagtaccaattggattcccatgaattctctttgcctggttctggcgtggtaataaaatgggtcaagacttctgagccatccatccctttccatttgaaggtatcatgaggcatccgattaaactgattccaactaatctttgtcgtcataaaagtatcaatgccacttttagtcaaaatctgaggcaatgcccaagaatagccaaaaacgtccggcaaccacaaatagtgaatgtcttgattgaattcttctttaataaatttcgcaccatgtaaaatctggcgggtcaaagattcaccagaaggaatgttacaatccgcctccaaccacatgcttccatccgcttcccaacgaccttcagctactcgttctttgatttttgcataaatttctggatagtcttctttgatatatttgtataattgcggttgtgtttgtaagaaaatatactccggatactcctccatcaaacgtaaaacagttgagaagctacgggcagctttttcgcgggtatgttttaatcgccataaccacgctacgtcaatatgggtatgcccgactgctgtcacagtgatcatttcatctttagggattgcggcaatcccctctgataattcggatacagccttcgctaccgaagtataaaatgtttggcttccaggttcgatccaattaatctggttgatagcatgatttaaaacatgggacaacttgtattgaatcgggttatcttgacctaattctttcacggtcttattgatagcatcagcgtaataaaatagttcatcaactggcaccatcatttgagatagctccgcttgcttaaattgatggacttggatttgttccggtccgccaccttccaaacctgaccaaagcttcaatgctacctcgacttttttaccacggaattcatcggcgattttaacttccttatgattggaatccacgccttgatagggttttccattaatgaacatcaatgattcaaagccggagttgtaaccaccaccggtatgaccaaaattcaaatacaaatataaatcgtcaacatctggcatctcgatttcttttttaacccacaaataaaaatcgcggcctttccaagtatcccctactgaaaaagtagcagcacttgaaaaatctttgggtggatattttgcttctttggtctcatcttctacaacaagccaatcagacaactctactatttttgaaaagcgatattttcctaactcttcgattcttgcttctaatttttctttcaagtaaaacaaactcatgaactattcctccacccttttcattttgtattatttgtcaaattaagcgagacaaaactttccatttacgtaactcaaaaaaacttctaatggtgtttggtaatttagtgattttctagggatatggtttcttttggacgcaacggatgagatgaatccttgattgacttggttgaagtccatttcttttggtagtccatcttttcggaggagtccgtttgaatgttcatttaatccccgttgggaaggcgtttctgggtctgcgaaataaatatcaatatcattcgtattactaatacttttccaattagagaattcttttccacaatcaaaggtaattgatttgaaaagatttttgggtacggattgaagccattcattaatcgaattttcaatatcaactgccttacggccttctggtttcaaggcgataatggcttttgaaagtcgctcaacgagtgtgatgacggcacttttatggtggatgccgacaatcgtatcaccctctaaatgtccaaattcttcttcgaaaacgacataatcttttttacgttcagaaatatttcttttgaatgcctgttttccacgtttttccttataaccatttggttttcgttttccttgcatcggtaaatgtaaaacattgaattctcccgtcttaaaccggcgatagagggtacttactaaataagagaaggttcgctctgcacggccaataatgacgtctggggtccaaccttcagttgatctttttgcaatgtattctttttcctcagcaggaaaaatgatttcggttctcccacaacgtcgcttattttctttgtattgttcaaagtattcaagtgctgttccaccacatttgagaaagttatagacattgtaaattgtttggcgtccacgtttaagctgcttcgcaacgatagcaaccggagtttcttgataaaaatatgcttctatcattacaagctcgtttggtgtaagatgggtataagtcatttatgttcactctccttgtatgctttagcgggtattacaatttgagtgtaacataaatggcttttttatttgtctcgcttaattatacaaacggcgttgtgaaaaaatttgcggggatccgcacctttttccatcaaaagatccattactttagtaaaactaaaactaaataaaacccctaaaatgacggccttgattccatatgaaaacagccccaaaactaaaactgcgatattaatatacctcaagaaaacagccactgagattttggggatttttttattcaaaataaccgcaaatacatctaaacctgctgtagaagaattttctgacaagcagcaataataaccgatggcaatcagcaatactgccaaaagaaaatcaaccacaacatttgtatgtagtgagaatggcaagcggtagaaaagattgaaaaacagcaaataagaaacactgctaacgacggaagagaaaaagaaaaatttccctaaaaagagcaatgaaactgccagtaatgtcacggtgatgacatttgtaaataaggtgatattgagggaagtcagattactaaatatcaacgaaagactcgtcacaccaccattaatgatctcatttggaaccatcagtttggcgtatgctaagcccaaaataaagtttccgcaaaatattttaaaaaaagattttagcaattttattcctcttttctaaaaatccaaatctagatcctgatacttatcatcattatttttttctacataacttttctcaaatgctttataaaacggccagtacatcaaagttgctaaggcaatggttgcggcggtcaaaatcaaagaacgccaatccatcgttgccaagaagctcgaaaatggtagtggtaaatctgccacaaaataagtcggtaatgaaacccaaccaagtttgaaaacataccattgaataacccctaaaatcggagtcccaatcacaaaggggataaaaaagtatggattcatcaccaccggtatcccaaaaacaattggttcggaaactgaaaacaaggttccactagcggctgttcgaccgagattctttaatgttgttttcttactcaacaaagataaaatcacaatggcgccagtaattcctgatccagtaacacttagaaaataatcccaaaaattaggcgtgaaaataaactgcggtgcctcgcccgtggcgattgcttgaaagtttgcattcaaattactaatggcaaatagtaaaacaattggcgctaatatgccatagccattgatgcccatgtaccaaagaaacatttcaagaaaaacaatgacaaaaaccatcattgggttatcaatgtttaaccaactcaaaatattttctaaatgaattcctttaagctgagacaatatttgatagataaccatgaaaatcacgctgaaataaatcatcagtaacaaattatctaaaaattccattggtgtcttgatgatctttttaattccccgcagcactaattgataaccactcaccagaacaaagctaactaacagagccaacaatgctaaaaatagtgtttcaattttagaagctgataataaattcagatcttttgctgaaaacatgagatacaaagccgcactgcatagatagtagtgaaactttcctttttcctgaaacatcaaaaagcaaagaatccctagaaaaaaccagccaaaattatccatcagtaataacaacaacttagacgtcaaatcagcaatctgttgttggtggataaacttttcatttacaagtttcaaaatagccaaaaccgaggaaatcaataagacataattaaggtacaaaaaagtttttttcatacttttaaaaacttgatttccttcgattttacctaaagtcggaatcatttttgtttggatttttccaactacctgattgatataatctaaagtcacggctatccatccttaattagcagttttgatttgataaattgcttctttcaaaatattagcggcattcatactgccatagtcagctgcatcgatgactgttaccggaatattgatactagctactttttgctcaatttcattgcgcctgtgtccgatttgtggtcccaacataataatttgataatccttcacttgttccgtgctgatatttcctgctggaatggcgtcaatcattaaatcaaaagaagacaatttttgactcccggctgccacttgtttcattttattcaccaagatactggtggatgaccctaaattacacgctaagcaaattgataatttctccattttattctcctgccttatataaattaagaaattcatcgacaatcgtcgacatcaagattgtattcattaatgtgtcttgggcgtgaatcaataaggcattgatttgattatcatcgccattgacttcatttacgatcaaactcgtttgtaaattatgggcttcattcatcaaagcctcggcttcttgtttcttttcttctgctttttcaaaatccttttcgcgggcatctcccaatgcctcgatcatcattgaaaaagctgtaccagccttagaaatcaaggcgaaagatatttcatccgttgtcattgtcatgttacacctcttgcatcatcaaaatatttcggatcatttgttcgatccgttgtctgtttttctcatcggctaacgaaaaaatcgtttcttcatctaagacccattgcacgatcctttcgacaacgtgataagatgtgcgatcttttacggcaattgtcatgatcacacttaccggaaaaacattttcacctggaaaagtaatcggttcatgaaaaacatgcatactaaagccattattaagcacgccatcttgttcaccagcatgagccagcaagacacccggtgcaatgatcatataaggtccaaaattttcaatattgctgataatattattaacatattgttcttcaatcgagtgctttgccaaaagttcctgcccgctaatgcgaatcgcattttgccatgtttgcgctgcttgatgatatttcaacatgctggcgtcaaagataaatttttgttcattgggacgattattttgcagcaaattattcgccaaaattttgataatctttgcttcaagacgattcatattgatatcatcgttaacctcttcgacgattgcattcatgatttgtgaaagcttgccaaggcgttgggtcgcaaatgagtacccacctaccgatagtttcaatttaatttgttcaaagaaactttcggagaagacattgtccgagtatagaactttgtctgactcgacttccggcaaccgaaccgtagtaatgatcaaatcataatgatcgatcaagggtgtctcaaattcaaaaactgaaatcgtatcgatccacttcgaatcgatcaaattactgattttgatttttaacacgctggaaattgcacggccttcaccacaaataatcagaattcgcggcgctttaaaaacttttggtgcattcttttcaatttcattgatgtaatacaatgtgatcaataccgcctcaggtgcttctacactttcaaacaacccattttgaaaagaacggattgccgcaaaaatcacgtaatacaaattcttgtggtcttttactagaacttcgctatcaatatcgcgaaaaggaatgccattttcctgtctaaaaataaagcgttgaatatgatatagtagtgcgttagaggccactttaaaatcctttacttcaaaaacatcggctaattcacggttgatatagcgaatcaatcgcttggctagattgatgttttccatttgattcggattattttgtttgatttcactaataaaacttgaaatcatttgtaatttttccgttcgatcagtcatctcaaaggcattgatcaactcacgatacttatagttcaaaatcgttaaaaataaaaagttcgtatcatcaatttcactggccatctgttttgaatactgaatcgtctcccctaaagaatcaaagaggatatccaaatcaaagaggtcaaaaaatactaagtcgccagcttttgaatacaaattatcttgatagtagaaactatagatttcacgaatattgatcatttttttcaaaatcgtgatgaaataggaaaatcgtttaaaactatactcctcaatcatgtaaccttttcgtggtacattcgataattcgatttcttcttcagccagttcctgtgtgattcggtccaaaacatttaccacagaagtccgggaagtcgataatgtttctacaaaataattgattggcaaacgttgatcacttagcagcagtttcaatgagataaaatattcaatttgctctgcggtaaatttaaactgctctggcgtcgagtgagatataaaaaaatcaatttcttttttgatttttcgtcgttgttcaatgaccagccgatctttttcaataaaaatttgattcaactttttttcaattaaaaagcggttcactttatcaatagcatagcgaatttgatggactgagagcttcaattgtttttttagttgcggcacagtcgtttcttcttcaccatctaaagccagctttaaaagatcaatttcccgttgactcaatttcattaatagacctcctgcaaactagctaatttcattttttgcacattaatgatcttatttgtgcgggtaatcaagtacccaactgtaatgatcgataaagccggaaacagataagtcaaaacactcagcgcgatcattaagataatttgggtaaaccaggtaggaaaaccgattaagatgaccttgacactattaagaaatgtttccttcgtaaaaattgttccaactgctagcttgtgcaataaaatgaaatacagtggaattaagatcaaggtacaaaaggctaaaaagaaactaatgataattgttgcaccgccttgcaactgcgaaagcaaacgcgcatttaggaaaaagataccggctacaaaaactgctgacatttctaataagagactaatcaagattgtctgacgtttttttaaaacttgccatttatcttcacttttagtttctagataaacaaacgccgcaacgattccataaaagaaaccaattatcgtcattgccccgatcaagatcaaaccactcaataaaatcaagtccattaattttgcttgtaaggcgataaatttttccttcatattaacctccatctcgactcgctccgctcctcgagtcaaatagtaatgaagacgcggatttccgtttataatagaattaggagaggcatactacaaagcacggtgaggtgagttgtaggaaacctcgattgtttgaaccagcatattaaccagtgtaaggtcggggcgttcaagcacaaatgagcggaactatagaagtccgcacactaatcattgttttaacaaatcctgttaaatgctgcccagaccagtcactgcctctccgctacttttagaaaggggcgaagaatcatgaaagtcgtttatcccgtttgttgtggtattgatgtgcacacgcagccgttttggtgaaagaaaagaatccgtactaccgtttgaagtacgcgcgcatttacaaacgacgtggtaagaaacgggctatcatcgcgattgctcgaatgatgctcacagctatctaccacatgctttcaactggtgaggtttggaatccgactgacttatataagattgatatgccagacaatcttgttcaaaagcagaaagataaagcaattaaacaagcgaccaaattactgatttcagaaggtttattgccagatgattttgttagaaaagacttagagccagccatctaaataactttcataatcgtcagacctgcggtttttgacgtttatttgccatgcgctctattcttgggtgtatctccgatactaagtggttttgttttcacactaatacctctttctattgcttaacggcaccttctgtgataccagaaatcaattgcttactgaaaatagtaaagactaagagtagtggcaaagttgccagtaacgtaccagtaattaccaatggataatttgttttataaagtccttgtagttgtgtcaaagccaacatcaacgtgtattttgattcatcgtttaagataatcaatggccacatatagtcattccacgcacccataaaagagtagagtgctaaaaatgctaaagctggtttcataattggcaatacaactttgtaataggctttaaaaagtgcacaaccatctaattttgctgattccaacaaactgtcggggatggcatcggtacaatactgcttgatccagaaaataccaaaggcatttgccatccctggaataatcaacgccttgtaagaaccaacccaaccaaatttatccatcaaataaaatgaaggaataatattcagctgacccggaatcatcatggttcccaataagaaagtaaagagaaaggccttccctttaaagttcagcttggcaaatgaaaaacccgctaaggaatcaaagaacaaaatcagcagtgtcgaagttagtgccacaaataaagtattaaacaacgagctaaagaatgttgtttcagtaaaaaccgttttgatattattcatcagttcagaccctagcatcaaatctggtggaatatgatagatttcactattatctttactggccattacaatcatccaataaaatgggaagatcgaaagaaagacaccaatcgctaagaaggctctaacaagtattttaaaaatccgattgctcatgtttattcccccttgattcgataagtcgtcaagtaccagttgatcaacgaaaagaccagaatgatcaagactaatgcccaagcaactgctgatccatatccgtactcattgtttgtaaacgccgtattatacaagtagtaaacgatggtcatcgccccaccttcaggagtcgccccctggggtactaatacttgtgcttcagagaagacttgcaaaccaccaatggttgacatcatcacagtaaacaagataatcggttttaattgaggtatcgtaatgttccaaaaaatctgcatattggttgcgccatcaataacggcagcttcatagtaatcatttggaatttttgtaatccctgttagataaatgatcatgttatagcctaagtacatccaaatattgatcaaagcaatcacgattcgaacccaaaatggtgacgtaacccatttaattggttcaaatcctaaaaactgtaatagcgcattggctaagccatccagatttgagaaaatcaagccaaataaaattgtcaccgctacaacagaagtgatatttggtaagaaaaatatcgattttagtaactctttatgtttgataaatttcaaatttactaagaaagctaatattagtgccaaaaacaacatcgggaatgtcccaactgcccagatgattagcgtatttttgactgataaataaaagtcagcatcccgcaataaacgggtaaaattatccaaaccgacaaattggatatcccctaagccatcccatttactaaaggccaggacgcctgagaaaataactggaaacagaccaaagatcaaaaacaaaatataaaacggggatacaaaaacgtaaggggcaactttatcaaaactaaatttcttttttgatttcgattctgaattcatcatctcaccaatctccatccttagacctccatttacgggtctatgacacccaccaatttttaaaatttgatcgatgtcatatcccgaaatcacattctgattatttagacatctcttctactttcttcacggcatcgttccaagctttttcaggatctttgccttgttcagctaccaaaatgatttggtcttcgaaacatttgaaagcagcactttcacgtggatctgatggtacatattccaattcgttagcggcatcgataaagtagtgattaaattcttcatcaccgaataattcatttttcgctgctttgaaggaatcatcataaactttagtatttgatgggaataaagccaattcttcgtagttagcccgttggctgtcttcattcgtcaaatatttcacaacttccgcagcttcttttggatggcttgaagttttgatcaccgccaaatatgaaccaccgtagttagacgcggtaaatggagattttgcgatcatccattgttttggtgaaacgccattttcagctaagtcattgatcccccaagaagcttcgatcatgccaccaaacatgcctttttgaacagagttggcgccatcagcactatttccttttgttcccaaagtgtaaccgcttttttctgctttaacagcgtaatcccagatttcttttaattgaccgttagcgtaggtcaatttgccattttcatcgtaaatatgttcagtcatcgtgcgatttttagattgcaacaatgaaagagaagattggaagaaaggcatatcggctttttctttcatttgtttggcagcagccatcaagctttcctcatctttcaatgctttactgatttcttgatcgttcgttggcaaaccagcttttgcgaaagcgtctacattatagaataaagctgttgggccaatatcaattggcatggcaatctgcgtttttttgtcatttgtaaaacaagaatcccacttccattcaacaaagtcagcggctaatgtttcactatcgtaatccaataggtttacgaatttatcagcatatggcaggtaatcagaaatattactgttgattgctgtgatatctggtgccgattttgaatttaagctggcttttagctttgtatcaaaatcatcattggcaggaatttgtttaaaactcaatttgtagtcagaaaattcttttttagcattatccatggcttttttactgatcgcaccattgtaatagttgatagataattccactttatcactatttgaggcactgccatttccacaacctgctaataccaaaccacttaccaatgcgacacccatcatgacaatacgactatttttcttcatcttctcgctcctaagattaaattgacattaagtgatcaaaacttttcgctaaactgttaaaaataccgattttggaataatcttgttcgatacagtagtactcaacaccacttttttcgccccattcaacaatggctttaaaatcgacgtctccgttacctaattccgtcaagttattatccatatcttccggtgcaaaacctttgatgtaatctttcaaatgaacaatcggtgcccgaccagagaattttctaaattcttctaggggatcttttccagctaccgagatccaataagtatctggctccgcatagaccgccgtcccaaaaactgggtctgtaatataatccaaaatggtccgcccttcgactgtttgattaaaatcatattccggacagtgaaggccgattctaaaaccgagttttccaagagtcgcttgagtcgtgaccaattgttgtttcgtttggatatagcctttcgtatgttgctcttcatcatcgatatatttatcgtagattgttttacaaccaaacaataatgattcagaaataattccgtctcgatcattgaaaaaacgatcatgtttaatgtgcatcccggcaattttgaaaccatacttatcaactaatgctttgatttcagtttctttgtgcccccgcataccatcaagctgaacggcttcaaaaccaatttccttcaatgatttaaaagtattttctggatctttttccagttctttacggacggaatacatttgggccgcaatctttgttttatccaactggcttattctcctttcttcagacgcatgatttcttcagcagataattgaatattcatcgcttcaactgaatcaagtaactgccattcttcctccggaccaattgtggcatatgaggggaaagtttgacttaacacgtaggccagagaaatttggattggcttgacacctttttcttttgccaactcttcacaaatcactaagcgcttccaattcaagtcattaaaataaacagcaacaaactctgccatctccggatcgttaacatcatccggtgagaagcgatttccaaagaatgcttctgcttgtgccgaccaagaaatcaaaggaaaatcagtttcttcatgccaagcaatcatcagatcgtctgctgtcacacagttttcccaacgaggctcattaactttggctaaactaaaatttggactattgaatgacaaaggatttaatccgttatcttcacaatatttttttgcctcaataattcgtggtaactcccagttagaaacaccaaaagatcggattttcttttcatcaaccaattggcttaaggtttccattaatggaccgaccggctggctaggatcatctcggtgcagtaaaagcacatcgacataatcagttgccaacatttctaaactagtagtcaagtctgctaagatactttctggattaacacgcggcgtatctggtgcttcccgcactggatgacaacctttagtgataatagtgtaatcctcacgttttttatcctttaaccaactgccaatcaccgcctcactttcacggtaatgtctggcagtgtcaaaagttcgtccaccttcttctacgtatctagtgaacatcctatcgaccttgtccttgttgtccaacttcaaataatcactggaacccaagatcaattttgataaaataacgtttgcatccttaactgaataagaatcttgtttcattctgaagcccctttctttttgctctcttcaacacacccaaagaatagcaaattctaaaatcgctttcaacgtcttgaatgacatattttatttttttaatcttaaaaaaagttattaaagcgtttgcattattttttgatagggtttattttaataacgtattaagaaaggatgttacccttgattactttaaaaaatcacaaacttgaactattgcaatttaccgatatccacatcggtcaagctccttttaatgaagaagatcaaaaaacttttgccatgatcgatcaaaccttagcgaagacaaccgctgatttgatcgtgataaccggcgacttaatttggtcagatggtgttattgaacctacaaaagggttagaagctttagccgaaattttcaataaatacccgattccattggcaatcacttacggcaatcacgactccgaagaaaccattgatcgtcacgatctccacgaattagagaaaaaactcttcaatcatctggctttaaaagccaatcaattctttgatccaaatcaaaaagaatgttttacaattgaaattaaagatgataatcaattagttaatgttctttattttatcgattccggcgccaatgccttaattgattatgagagctacgactgggtttctttagaacaaatcaagtggtacgacgaaactttcgcgaaatatcaaaagattaatcatacaaaagatctattgttcctccacattccattacctgaatatctacaagccggcgaacggatcgtagaggggcgtttttgggaaatgaatccgcgaatttcggcaccaaagcttaataccggcttattcagccatttactagaaaacaaccatttactcggcactttttgcggtcatgatcatgataataatttcgaaggcatctatctgggccaacgattgatttacggaaatgtcaccggttataactgttatggcgatttgccacggggctaccgtaagatcaccttaaaaccggatcaaatgacgacttccatcgaaacttttgaataaagaaagaacagctagtaatctgctagctgttttttatgtagcaaaatcagtcctaaaatagtcattcattttaggactgattctaatttaattagtagttgtcgtttttgttgcttttcatccaataaaggtcacctcagcttacacaacactcatctttaaataataattagccacgttgggcaattagtactggctgatccccaatcatttgccagcgacgcaacatgtacttcccccgttttcgctcaaacagctgtaattcaaagatttctcgattcttggggactacctccatctgtaaaagcgccgctaattcagaaacaaagacatgttcacttgtttgataacctgtcgcctctaacaaagcaactggcttagatgtactcctatggctttgtcccgtagaaatcaacgtctctcgatgaataccgtacacactttgaacttctggtacatacaccgtcacccacatcattggactggcctgatccaggtgtccaagcagatcttcaacactccgaatcggtgaatcctcttcaaactcgtttctcttaagcatttctagtagctcagcttcaccatagcatttcaacatattttctgcctcctgctgctacctacaatcctgttctacttcagcagcaatcattgatacgatagtttccgtcccaccattgagataatacggctcttcagcctttgcagctgcaagtaaaaaagtaaaggtgtcttcgattgctttttctgaagcaagctgcatggaatgttccggtgtgcctggaagttttgaaattttatcccaaacaacaacaccaggaatactgtcgcgctccattgttgccatcaaagccataagctccccaatgattctttcctcatcgactgaagaaccagagatacttcccaagtaataagcaaatactgttacgattctacgccctgcatcgaaatagtaggcgtccagcgtgttctttcgggtcactgagcgataaatgtcttcgaattctttccgatcaatcattcgctgaagaatgacttccccaactcgaaactgattcgtcatatccggctcgttcattaatttctaccttcttttctcctattagttgaatccatgcactcatcatgatcgttagactcagccgctacctttagcaccactctaccgcagaaaatacgatttggaggtcgtctgaacccaattcagatacttcgccagtatctttatttgttactggaatatagtcgccttcagaagcgcgaatatcagttgcaagttcttccgcaataattttcgggacggttttgagcaggtctatatcatttgtaaaaacaaaatgatcgtcggttgattctatactcaaaaaaccgtgaaggttgtttgctgaatctaaaactagaaccgtatgatcttttactaaatagtctggcataaagatgatttctttcgatttatccattcgtaaactcctctcaagttccgcctaaaatactcgagcttgagaaatcttccggtataatgcgaccgcaggcaaattcagatccgttttagtcggattcacaatcatagctccgtggtcctcttccaactcattcatcagctgcaagtatcgcaaattcttctcgccctgtcccatgtcaccgctggcctgaatatcctcaaatacactcgcaatcgtttctagcgtccggatacctgtatacccctgcttcggttgatcctcaaatttaaccatgctttttttccacctctcgcatttgttttttatttttcaaaacttctttatctataacagactcaaaaacgctggcgggataatagccatgtttttcaatcataatattttcgatgacaagctttgctgaagtgactgccttcaggttctcgcgatccagatcatctgcttggctattgtggccataaacttttttcctcaactcacgatagacgcctctcgccagcttcagccgagacagcaattctacataggtcatctgcaataattcttttgtcgtcgtgtattggaaaaagaacggatctgtttcgacggtcggttctcgatacaatccagacctgaactcaatcagttggttctcaaaaaaatccagctcacaattggcacagtgatactggcccccttctagcttcaaaacctttttattacaatatcgacaaatcatcacaaatccccccgttttcacaaatagtatatcatgctaaataaacaatgctgctcttcttttttaccaagaattagcctacaagaacatacccaagctgaagactctcagcttaggtcatcctaagatcagactggtgcctactctttcccttcagctttcaatatacacctcataatcttcccacccattccaaacatcttccatgacacagtttcccgttttatccagtatcaagttggcagcgtgatccccgtaggtttcatgttctacaagaaataaacgacgtccgtgatacactcgactggcgtatacataccacgtacctatatgcccgcttaccttgatattgttcgatgttaatgaaatagtttttcgcataattcaacaccctttcaatgattccggaaaacaacctggcaaggaccaggtcgtcatccgaattacatgccttgcatttccgattgttcagctggtatcacacggtttccaacttagcaaaattttgttgctgatattcttccatcattgccccctcaacatgtttgtactcttccagacaaccctgtatttggtccaaaacctcttcagcggaaaaaccatcctgatttttcaaacaagcctcaatcccaatcagtgtaaaccattgtttgttgtaaagtgtgacttccaattttcttaaagcatccatgtaaaaaactccttttttgttggtttgaaacccatttttttaggagctagggcggagctggaatctttaaagaaattccaattttggtttgtccagtcgtgccctttgttcctatttgtcatgggttcattttttccagtgtgcttaggtcgtttgctgtggttatgctctagatcgggcccggtggcaggtaaagggcggcggattttgccgcttgtataccctttacctgccaccgggtttgatctataaccacaaacagcaaacaacctttgcacacaaaatgaaaccggaataggagcggcgattgacgaacaaaacaaaattcgctcggaattttcaggcgggagatttccccgccgtcttgcgagaagtcggagctatgcttcgagcaagacctttcaatccttttgcttttttgccctggcaaaaatgactgaatcggctgacttggcggaggaacgcagccaaccaaagcaactgcgactggcgaaggcacgtagccatcaagcggttagattctgtcactaggcaaaagaagactgtcgcgttttgagccaagggcaactgcaccgcaggcgaagtgacagtcttgcccttagtaatcttgaaggtagagcgagcacggttttcgctctaccttctgctttagtttaaaagggtctcaacagcttttttgtcttcctctgaataagggtaataacgttttgaagggaagaaattaccgttttcgtcgatttccaaagctacttttcttagtcctttcacgaaataataaattggttttttcttccattgaacaactgaaccggatgctatcaattgttcagttttaggactaagggttttcttttcatcacgctctttcatactttctagggatttaattttattttttaactgcgtaattttcgtgccataggtggccgctttgattgctggtttcgttttgttataggcttttgccttttcatttgcttcctcaagttctttcagctgttgcttaaaatactcgagattattcacgcttgttcttgcgccaacactggccgcacctgagcgccctacaacagcaacatcttgaataagttcattctgtactttaaatctttctaccttttccaacatttcgacacgatcttcttgctgttcttgttccactaaaagcttgcgtgctctcgctacttttttattgattggcgcataaatatttctacgccctagaatgttcggctgtccaaaaggaatcatttcccgctcacggtggatactgtcttgtagttggttttgagtgttattcaatcgttccagctttctttttgcctgctccagtttattcatcttaactcctactttctttcatgatttttgaaaccatttttttaggggctagggcggcgctggaatctttaaaaaaattccaatcttgctttgttcagtcggccccttcgttcctatttgttatgatttcattttttccagtgtgcttaggtcgtttgctgtggttatgttttagatcggggctgacaataggtaaagggcggccgattttgccgcttgtataccctttacctattgccgggtttgatctataaccacaactagcaaacaacctttgcacactaaagatgaaaccagaataggagcggcgattgacggacaaagcaaaattcgctcggaatttttaggcgggtggtttccccgccgtcttgcgagaagtcggagctatgcttcgagcaagacctttcaatccttttgcttttttgccctggtaaaaatgactgaatcggctgacttggcggaggaacgcagccaaccaaagcaactgcgactggcgaaggcacgtagccaccaagcagttagattctgtcactgggcaaaagaaaactgtcgcggtttgagccaagggcaaccgcaccgtaggcgaagcgccagttttacccgataagcggcttaccagaatgctgtgcttttcatcactctggtaaacgtcttatcagtttgcggttttaacccatttttctattatctgttcgatttcaggaggtgccgcttggtttctcttcccacgcaattgaacaatacggtgattcctcatttctaaggtgagatagggttcatctaacttgtccgctttccgaacaaagagaatcgttgtttctcccttcgcatgtcttctaatataatactgaccaccgacacaatggcgaaggttctgcccttccaccaacatctcgcccatttcttttggtgcaacaatttgaacatcacctagacgtttttcaagccctttcaattgcaatactcgctcattaaattctttttcatattctttattttctttaacgcctaccagttttgctttttcatcatgagctgctctgagttcctttggcatggcgttttccttatctacaccgattccgagttcgtctaacatgttgaggtagtccacatacatgccaaagtcaaggtcttgtgcaacggcccatttttgaaagctggttagcccaacgcatgttggtatacgtttcaagtcttccaccgtcagaatttcttcgattccagctattggttttccatgacactttctgatagcttcctttaatcgcatttcacagaacgtaattgtagagtttttcaaaattcctttgtgtttccgaagccatttcatgttaaccgttcgatagtcgatacttttccctcgtaccctatcccgtataacgtgcatagccgaaaataacatgtcgtccgcaaatttatccgcatgaatgagttttaagaactcaatctcccgccgatatttataggcgtgggcgagatggtaccaagaaatatctttgagattacaatattttagcggtgaattttttgccagtttttctcgccacttgttgggatagaactgcgtattcgtgtatgagccagtcatgtaaccatgattcagcaaccctccataccacttatttctaaaataatgttgctgataatgtacatcattgcagaaacattcaaggttcgttcgagcaatttcataggtttcgacaccattctcaattcctacccaaatgccgaaagattgaatttcaacacgagttttgctacttaacacgagcgcaaaggggtaacagcgttctgatctattcaaatttgaagcttttgtcaatcgcttggaaataatcggggcttctggtcgtgttgtcgaaacaattgtccgttctttgttcgcccagcgatagcccgtaatttgcgaactacaccacttgaaaaaccctttcggtggcgtgagtggtttaaatggataatcgtatgcgattttcatagtagttagaacagactaatctgctgttcttcctcctttcgttctgtttcaatcacttgaggtgttggtgtggtctgcatggttcccttcactgaacttgaatttttcatttcaatatcagtcgtgtaatattcccttacccactgaaaaacaacctcatcacttaccatcatagcggactgctttcctttgcttgctgaagctttctgaatacaaaattgaaccaattcggatagggacttttcttcttttaagacaccaattaataactcagaatcttcttgttgctctaaccaacccgcaagccttgtttcagttgggtttttagacgtttctagttgtaattttaggtgctctttcactgcccctttcaaatcgaattcaacttccagttccgagtgttcaggtggtgagaaaaaattgtggtaggcaatttcatcacagagaacgagccatgtttctttccctagaccgtccattgctaaatggacgggtgagtagccaccttccagtccgactgtcgcaactactgtttggtcaggatagacctctaatcgttccaaaaactctcccacagtcttcattttgaccgaaggtgccgcaatcaacgtgacccacgaaatacttcgttcacctttttgttggtggtcgatacgaaaatcaattgccgcatatccgagcgtttcatcaaaaatcgagagctgttttttctggttttcttccctcagtgcagacttcaagtctgccattcgtttgatagtaccgtttttcatggttttcgctccttttggtctttgcgctacacagcagtagccaaacgctgaattttttgcgttttgttgcgaagcttttaccatgcagcagccaggcggcaagggtgcgtagcacattgcttgcccttgccgcctggcgaagccacttgcgagaaatagaatgagtaggcgcagcctggaggctcattctatttcgtagctagtcggcgtctgcaatggtaaaaatgtagcgcaaaaccaaaaaattcaaatagaggaacccggcacgggttcctaccgctttttgatccggagaagttggagctatgcttcgacggattcctttaaatccttttggccttttcgcgtaggcaaaaatggtgaggtcagccgacttggcggaggaacgcagccaacaaaggtaactgcgactggcgaaggcacgtagccaacaagcagttagaccttgccactagccaaaaaaactgttgcgctttgagccaagggcgactgcaccgcaggcgaagcaacagttttgtcctttttttgtttctttctttgccacagatcactcgttttcttcttcaagaccaaataaaaaagcagaaaccaaccgatagtatcgggtagtttctacctgtggtattatgcaaaattcaaaagattatacattgactttcgaaactctacttcgttccaaaaacggttatcttttatatattgtacttctatgtccaattgagaatatctggatttcaatttcagaatcacaaatattagccaatattcgatagtttccaattcgatagcgccattccccactcttatttccagtcaaaccttttccgtgctgacgcgggtcagtcgtgttttctaaattctttctgatccaggcgacaattattttagcttggtttctgtccattttttttaattgcttctgggcttgcggcatgtagatgactttataattcatttagcagtttctccatttcctcttgagaaataccactctcttttttctctttggaaacttcaattgcactccgtaaagtccgtagatcgatttcatcttcgattttatccagtacagcatttcgataaagttcggtcaatgaagaattgtgtgcttttgcatattctaataccagttctttttcatcgtcgggaatcctaaatgtaatggttgattgagacatgattctacctccgttcatcatttgtactaacattgtactaaataaaatcctttttgtcaatacaacgttagtacaaacaagatttgcatcatatccattattcaaatggttctgttgcaaagttttaaataaagaataaaatcccttacggtatctatgatttaagctgggattcccaataataccttgatttcagtacagaccgaaaacccgaagagagtgccttcttttcgggttttcttatataatcctcggatggcttccatgcctttaatcgtggtagaggcagtgcgtaaacttcgatagaatttattgcgtctctttactggacgatggtcttgttcaatcaaattattcaggtatttaatggtacgatgttctgtcccttgataaaagccgccgtattcttttagtttcttaaaggcacttgtaatagagggggctttatctgtgactacaaccttcggttcatcaaactgcttcactaaccgcttaagaaaagcatacgctgcttgtgtgtcccgttttttacgtaaccaaatatccaaggttaaaccatctgcatcgatggctcgatacaaataatgccattttcctttaattttgatgtacgtttcatccattttccatgaataaaaggattttttatttttctttttccaaatttgatagagtagtttgccatattcttacacccaacgataaatcgtcgtatgagaaacgttaatgccacgatcatataagatttctcgaacttcacgatagctaaggttataacgaagatagtagcccacggctacaataatcacatcctgctgaaattgctttcctttaaaatgactcatcgtcattcctcctgctatctttttctattattctaccttatctgatagtagatttaaaactttgcaacagaaccaaattatctagttatcatgtgtatcagaatgaattctacagggtctttgctcgcctgaggcgaggcagtcaatggatctaatccaacaatctaacgatttttttactgggaagttatccagggagaagtatgctcaaaatgccttacacccaaaatttattcctcaatatttttgaacagtgaatgtttgaagtaactttttagtcaaaatcagttgatagggatattagtgatacatatttcaataaaatgtgccaaagaattaaagctatgaattattcaggttcaggaataaaaattatttttaataacaacctattatcctttccaagcttgtagatattttggtttagatgttttttatgtgagttcaattctacagcggagggaatgagaaagttttctaaacaagtttggaaattcctaaacatgttcagaacacacagaaaacaattacattctaaagaagattctttatactagattttgaagaaacagtggccacagcgttcttctatttataaatagccttcagcgccgcgctcaacaaaagctcaaattgattcagtgtcgtgccaaagaaaagatttggttggtaatcagatattttttgtggaatataggtttccgtgctaatggttaatgttgccagcgtaccgatttttgaatttttttgcccaacaaatgcgatcacatcgataaagtgatcgttcgcaattttagctaattcggctaatcgaactgtatcaccagaattggaaataataaaaagcagaatatcttgttgcacttgctgtctaagaaattctaaatgactattggccgtcgcacgaaatccatatagattaagagattccgaaaaataattggctagattttgcgaaaaacctgagccaagaatcataatccgtttatcgcgatacgcagacattaaatgtatgaatcttccttctcctcattggagaatgtgcttggcatcgtaatgtcagattggctgtttcctagagcaaataccaactcactataaccggaatatccaattttcttcgccatattgataatcgttgcagtagaaacatacgatgctttggcaacgtcacgaatcccaatattttttaaagactgacgattttttttcataaatcgtaagacttcagcttctgagtcattcagttggtatttatctataagcatttcaacatccataagattcacctcaaattttatctaataggagtattatattatgacagaaacgaaatttattcaagatccgtggtcaaaaatgactacccgtaacggcttacgtggagatgaagctatctcagcattacagaaatcgattcgtcgaggaaaagaaaaagaagcatgtgaatttgcttatgaaatgtatatcacctcaccacaatttgaagagaaactctggagaaggctattggcgatcagtgttgaggatgtgggcatgggcaatcctatggccgccatcatgatcaataacttaaacgccatgcgcaaagaattccaatacaatgaatccgatcgtgcgatgtattttttccacgcgattcgttacctatgccaatctgaaaaagatcgttcatcggatttacttaagaacattgttatcaagagtttcgctatgggatatattccagaaattcctgatattgcgttggataaacatactgttcggggacaggcaatggggcgtggttcagaacactttttgcatgaagcaagtaaagtgatcccccaagcaaaagttgataatgactacaaggaacaatacgaaaaaatcatcgagacctatgatccagatcacgtcgtgccaagtacgttttcatttaatccttggcaagtatagtctaatggtgataagtcaagatgaaatttaagattttctttattgagtaatatgttttgaagcgcacgaaactagacccgatcaaaatcaaatttttttcgggttgattcaaggatttgcgtcaataacggattgttatttctctatcacactccttggtggcgtatagagttggtgtttacgtagtagcgtatccaccagacgcgtaaattttcttgcggttaggacgagtgcacgtttgtgttgatgctttggaacctccttatatttactttgataaaaagctttgtattcaggaagataattttttacagagttggcagcttcaactaagtagtatctaaaatatcgatttccttgttttgtcagaggtgtattttgcgactgatagtttccagattggttcactttccaacttaatccagcgtattttgccaattttgtctgatcttcaaatctttcgatttgaccaatttcagcgattaaaccggcagcatagactttaccaacgcctggaatactggttaagcattgatattctggaatgacaacaattacttgttcgatggctttatctaattctttgatatttttttcaagtgctcgtatttctcgtacgagaacacttaaaacaacattaattgattcttgtgcaagagcacctaggcggtaactcatggtaattgcacgttgaattgctttagcgattttttctggttgcttgaaacggccttttcctttttcttgaagtaaatcacagaaagcttctaaaggaagctcagcaagttcatccaatgtgaaatcttccgtcatgagtgaaatgagggttgcactaaaaagactcgtcgattcgtctcgcatttctcgagcaagcgtattacatttgtacgttagattttcaagaaaatgttgctttgtacgaatcaattgcttaataagttgatagcgagtacgtgttaaacgctgtaaggccatgtatttctcttctttgataggggaagttgtgaatcgttgaatacgcaagaaatcagcgattcttaatgcatcgtttcgatcagttttattctcatcaaacatgcgactaaattgtttcacccgaaaaggattttcaatcgttacaagtgtgttgagcttctttagtttctcatcttcatgaaaaaacatggaaggatggaagctgtacatggacgttgactccatgccaatcacaatttgatcaaagtggtagctgtcattgaattcaagaattgtttctcgtatgaatgaagcaccttcgatgtcattggcaacagagatttcagataagatagacaattgattgtcgtctgttaaaaaacaaacatctagtttttcagagctaacgtcaataccgacaaataatttcatggaagaaggacctcctttcgatataaattttggaaaatgcttcgatactgtgggatttcccagaaactcactgtatagccacaacctcgcctaatagaatacggtgataaaagagctagaagctgccttccaaactactatttgaaagtctagtccattatcgaaacagctaatgagttggtagtgataacagtggttcgggtaacagactaaacagggtagacaaacgctacaggaggaaatagcaaattcccgttggatcctttccatacatccattgtactctgagaaatcacacaatatcgaaacaaattccgttaggaatgtgttattcaataaattttataatctagaaacattttgaataaaaactattagacaaatgatattttacgaggaggaagttatatggaaaattctgcgtttatcatgaaactgaatgacatacttagccccatcgcagccaagataggtaatcagcgccacctaaaagctatatccagcggtatgatgtttggcctaccctttattgttatcggttctttttttctgatttttgcaaatccacccatcaatattgataaatacaatccagatacagctaatattttcatgaaatttatggccagctggaaagattttgccgtagcaaattatgatctcatcacagccccttataatttgacaatgggaatcatcggattcattagtgtttttggcattgcattttcccttgccaatgaatacaaaattaatccttccatgaatggcatggttgcatctgtcatttatctaatggtttgtacaccagtggaagaaggtgccatcaatcttaatttccttgggacaaacggattgttcgtcgcaattatcatcggcttgctagtagtggaaatcaaccgactatttgaagtaaaaaatattaagttgaaactcccagatacagttccacccatggtagcaacctttatcaatatgctcgttccactgctgacaaatatattcatcttttatggcatcaatctgattttcttggcagcaacaaacaaaatcttccctgaagcggtgatggaagtcctgactccagcaacgaacatcgctggcagtctaggtggtttcttattgatcgtgactttgggtaacatcctatggctatttggtatcaatggctcgtcaattattttccctatcgtctttacattgggaatggctcaaactggtttgaatgctgaacaactggcaaatggtgaaaccatgacacacttaatgaacttacaaatgttccgtatttctgtacttggtggagccggtggtactttgggtttggttttattgatgatgcgaagcaaagtacccgaatatcgcacaattggaaaattgtcattggttcctggaatctgttccatcaacgaaccagtgattttcggattacctatcgtttttaaccctattttggcaattccatttttgattacgcccatcatttcattattgctgacctactttgctcagcaactaggatggattgggattggatttatcgtcgatccttccttcacacctttttttgcacaagcttatctttcaagtatggactggcgcaatattctcttttgcctactgttgatcgtcatcagcatcttcatctactatccattttttaaagtcatggagagcaataaaacaaaattagtagatgaaaaactatagtcgtcattcttaaccttgtaacgaaaatatggttctatactatttagtgttgatgggaaatcttagggtttcccatcaacctattttttataaaaaagtatactctggtgtcccacaacaaataaaggaagcgcccttgttcaaaaggctacttcctttatttttattttgctttaaattttgagtcatcatttataagcgaacgtaagagataatagacacctaaaaatagaaagaaaaataaaggtaatacacgtagtaaaacaaatggagtttcaaaaataaatggatagcataaaatatcttgtgtaaattcgtttttctagaaatgtagaaaaaaaggtatatccttagtaaaattagttcgaccaaaaacaatttacgaaaggaatatacccatgaactattttactacatctttaatgaaaaacctattttctaatgacaacaatcttccagcttttgaacaggctgtaaccgaactgtttcgttcagagttggagaaatctctcaatgaaatactcgcatatgagttgacggattttcttgattatgaaccatacgctagaaccaataacgaaaattctagaaatggttcctatcaaagaaagtttgatacaaaatatggaactattacactcaatattccaagagatagaatgggagaatttttcacttctcttctgcctaaatacagaagacgagatctatttaccgaaacaacgattttggatttatttgaagaaggaatgagccattcagaaatttgttccatgatccaaaaattatgtggagctcgctattctaaacagaccatatctaatattacggacaaagctctggaatgtgtagattccttcaaaaacagaatattgaacaaagagtatgccgttgtatatcttgatggaacatccatgcctttacgccgtgatactgtatccagggaaatggtccatatagcactaggaatcacagtagaaggtacaaaagaaattcttggctatatgattgcaccaaacgagtccgctgagatatgggaagaacttctgaaagaccttaaatcaagaggggttgaacgtatttctttattttgtacagacggattgtctgggatggaaaatgtaatacaggacattttcccgggctctaaaattcaaagatgcctggtccatattcaaagaaatatatgtgcaaaagtaagagtcagtgacagaaaagaagtggccaatgaatttaaagaggtatatcggtccaaatcaaaagaagaagctttaacttctctaaagaaattcatcgataggtggaaacacaaatatccatcaatggtgaaaagtctcagcaacaatgactatctgtttacattctatgattatccagaaagtgttaggcatacgatttattcaacaaatctgattgaaggaaacaataaacaattaaaacgaagtttcaaaaagaaagaacaatttccaacggaaaaatctgaagagaaataccttgtgattcagttcaatcgttacaacgagaaaaacatgaatcacgtacatagaggttttggacaaacaaccagagaagattggttcaagagctaatctgctttaccaaggatatacttttacacataattcttgacgctacccctcatattaattacttatttttttctcttttaagtacattaatacttcatattcctcaacatgcttacttacaaaaacattataaaatgaagtacctaaaaccatagcaatcaatgttaatatagaatagctgacaataccccagtctccagaaaacatttcaggaaacactgcttgtggaagacctagtattagaaatgaaatataacagatcataactacatttaataagtttttattcctatccaatgcaacttttttttcggctataattaaattcaattcactagtttccatattcataatttcattatagtaattctgcatattttgatttgaaaatctaatttctttcataaaaatccctttcttgcaaaattatattagcctcaactgaaagatttatttttttgctccctaacttcattagtaataccatgtttcattcgatatcttctaaacgttctacgattaatccctgttagctcttcaacttctttatctgtagatccagtcaaaaacaaattaaatgctaattgaagtcgcggatcattctcacgatattttggcgtacctcccttgtatttcccttttgctttagcgagtgcaattccttgttgttgcgtttcgcgaatataccgacgttcttcttcggcctggtacttgtatagttcgataattaagttattaagtaatcgacgtaaattatcatcagtgatacctgttaacgctggcaaattcaaaacttccagtgtagctttcttcagctgaattaaattcatcgtttctgttagctctttgttatttcgttcaagtcgttttaattctgtcacaacgacaatatcaccttcacgtatgaatttcatcatttcttgaaatccttctcgattggtatctttcccacttgctttatcactaaaaattttatcacactctgataataattctaattgtcggtctaaattttaatctaagctgcttactcgagcatacccaattttcgccataataaaactcctttaaaattctgaaatccggatcatttttaaattctgttgcccaactctgttgtcatttttctagataaatggcataaattttcagcgctaagtgacaaaagcaactaatttttcatgatagatttttaaatatctcaatctatctccaaaattagttgcttttgtagctatagttgactatgaatatgacaaataattagaaaaaactgtgccaattaaatataaaaatgacaaatgttatggtcgtgtctatttagggtataccttatatagacaaaaactaatgatggaggaaatagcatgtgtcacttttctttttaaatggcaatattttttgtaaataaatgtcaatcaagaaaatttaaacgattatgacattaaaaatatattttatgaattttctagtatataacttgatttatctgttaagatttattaagaaaacgttttcttatttttgatttcgaggtgatagacaatgaaaaataagtttattttatctttaggtattttaactattggaattagtgtaactggaactacaattcctacatttgctgatagtacaaatgaaccaactactgtagtagataataaccaagaattaactcctttagataggaacggaatagccattggtaacccaactaacgacttaactgttactgaaaattatttaatagtttctccattacttgctcgagcagcttctaaaacgatacgagtgacaggaacgatgatttttgataaagttggttggccttctagacctcctcaatcacggaattggaaagaaaaaagaaatggttattggtactatggaaaattgtatttacaaagttataaatcagctggaaacaattggattgcgacttattcaggaaccttaactagaaagtagggattttttatgccagaatttgtgaacacaccaaatttttatcaagatagcgatattctaagtaaaattaatttaccgaaagaagaatcagctttacaagttcagcgaactttacaggagacacaaaaaattcaaaaatcaatttctaatctagaagattctgaagaaaaaagaaaaaaaagagaccaaaaaacatatcaaaaagaaaaataatgattttaaaaaaagagtgtctagtcgacattctttttttctaattgaaagtgttcataaaatcacccatttctggacactttctgtcatttttatatttaattggcacagttttttctaattatttgtcatattcatagtcaactatagctacaaaagcaactaattttggagatagattgagatatttaaaaatctatcatgaaaaattagttgcttttgtcacttagcgctgaaaatttatgccatttatctagaaaaatgacaaacattgaaaaatctggttttctcatgtatgattagggtgtgttttaaatagttgcagaaagtaggtaaaaatttgagagttgcatacatacgtgtctcatcgatcgatcaaaatgaacaacgccaagttgaagaaatgaaaaaattcggtgcagagagaattttcatcgagaaacaatctggcgctacaattactcatcgacctgttttccaagaagtattggattacgtccgagatcaagatatttttattgtggaagctattgatcgacttggaagaaattacgacgagatcatcgcttcagtcaattacttgaagaagaaaaatgtgcagctgatcattacaagtctaccgatcatggccgaagcaattggcaatcctctcctggataaattcattaaagatttgatcattcaaattttggccatgatcgctgaacaagaacgtaccgaatctaaacgacgtcaggcacaaggcattaagattgcgaaagcgaacggtgtttataaaggacgtcctaagctatacagtgccaatgcaaaagatccccaacgtcgtcttgtttataaaaacatcgttgaggatctaaaaaaaggtgttgcgatcgctaagattgcaaaagactacaatgttacgagacaaaccgtatatagaataaaaaaagacagcacggtcaatcacgaatagttgatcatgctgctgtttctattttatttgcttactttttgaaaaactgttctaactttcatcaataactcctcaactaaactatcatgcgctttttccaaaaaaatacactctctggcttcataatcaattgtcgttagttgatctaataatacttttcctgttgtcttcatttcatattctgagtttatatttacatatagcggatagtttctagttgtactagaaattggagcaactgtaacaacgttactataatccgcaataatatcatgacttaaaacaatataaggccttttacctgtctgttcgtgtccagatcgaggtgctgtattcaataatagaatatcgccttgtctaggttttctcaccatttttcattacctactgcttcacctaaattttgaatcgtcacatgatttctttcatcagtgtaattttcaaataactgttcaattgttaattcattttctatattagccgcttcgataattagccgcttctgaccgtttacttcttcttgtattatcttcactttgtcttctgtatgaattccaagatattccataatatactttggcaatctaaggccattactatttccccatttttttataggtaacatttccatagtagacacctctttctgtatatacatagtataacatacataagaaaaaacgtatatacttaattatccttttctattaaattagattaacattccatgaatccataaactatgttaacatttatatgaaaatagtcgaaaggaaatcataatatgtttaagaaaacaaaatctttagaatcaggtaagaaaaaaattgatctaaaaataatctcttctggatactttaaagatttcatagttattgatacaaaatggaataaaaaggacatagaaaatattctaaatagtaggaacaattaagtgctatcacttttgtttcttcaaatgaaaagtgacgtcactttttgagtgctggtacatcaaatcctgctttttcttgcgcgatcaatagatctaacgcaatacacataatcttagattcactttttccgtacttctgctttagtttctgcaattctttttgtctcttttcatccaacgtaacgggtaaccgtttatttcctattgcaattggcattagtactctctcctttcatcgaaataaccctatgaaaaatatggctgcaatcaacttgaatattagactcacaagggctaacacaaagcgccaaaagatcaaacaaaacaccagtattaccaaaaatactacgaagtttaaatgcacagctgcactatgtcgcataattatttcgccaacaaacagtactaacaataagggaataatcttgttcaaatggatcaccttctttctcttgagttatcgggctttgcccgtttatttcgcatcacctaagcggcgggggcggttggagcgattggtgcgaaataagaaccattcccttagttactaggctttttttgtccttatttcacacattctcacttttcggtataaatgattattgacctttttttctttcaaatcgttgatatggaatccgttgttagttgataaatcaccttattcattttcgttgtcttcctttttcatggtgtaatatgcgccatacttattgatattttcaaaataatctaaccattcacttgaaacagtcttggcttttttcgtttcgataaatttcgcatacgttagttctaaagcttggtattcagaaggtttgattgtgcttggtttgacgcctacttccaagcatagtaaggcttggaaaaaccattttgcattttgctttttcagttcttccagtgttcgatagtacgtcgcaatgagattcatttcgacacctgattcaatcatttcttccacagctaccgacaatttttctttataatgtttctttggaacacgtgtttcgttgtataggaacgtcatatcctccattttttgtgccattttatccaaaggtaatttgacaaattcgtcatagtaattttgagccatatttttttctcctttttagttctctaatttggttaaccaatattcgttttcataagtttccatgttttcttgataatgcagttcatatcctgcaatcttcactaggtcttcaaatagcatagtcggtgcatcctctactaaaggggtttctatcgtccagtaccgcggaataagtaaagcttctgctactttttcagaaatgacttctttgtccaccaaaatttgaacgacttcttttacagtcaataatttgtgttgtgttttcatcagtgtttctttcctttctcatcaatcaaaacataatcgccataagacaaggtatattttttcccgcatgtttgacattgatacaaacgatagcttttgatacatttcgctctttctccacaatcgcattcgacagtatgtggtgcatgatagtttgggaataattcgctgaagggaacaccccaataatcaaatttctttcgcatgattgattctgcctcctcttaggaaagggtttacttcctttcgttagttctttctttattgatttgttggccagaatgaatcaacgaaaagcgacaaggacaagggcgcgcagcgtgccatttacccttgtccttgtcgctttttggtgataaaaggcaacttgttgccggtctggcaaatcaataaagagatagcgaacaggaacgaaccttttggtgagaggaagtttttcctattttgtcttgctttgcaagaccccttatcttagtgaacgtgcaacgttcacttcctttcttctcgaacggcggtggcggttggagtgagagaaaggtttttcaattgagaaggcgcttgtgccttcctaaacaggccttttcctgttcccgtttctatgtaaaacaaaaagagctgcaatcctcatttaggactacaactcttcttttatatgcccatcgatcgcgtaaaatgatcgggatttctaacatacatgctagcaataactagctgatttcgtttattgaagtgacctgtgacggcaatattgtattttccatcatccataattagcagtttatcgataatttcaatatctgcaactacacaattaatcgattcatgaattgtttgtaaagtaaagcgaaccaataatggttgtgtttttattactcggattttatcaagcaaaccaacatatttgtccatcacaatcacctcgctaaaattatagcaaaaacaaccaaaattgagaatttttattcgattttagatatgctataatagtcaagacagtaaagtttgaagacggtggcgacttctggaaaggtggtggtgcttatgaatgtaagtgctaaaatctatgaaaggagtaagccttttgtccgcatatgagacaattcaaaccattcttggttttggtatgtttaccattgctttgattagtttgattgtaaatatgcttaaaaatgacaaaaagaaataaccgtccactttagcaggtcagcggttatttccaaataactaatattctgccaccgttctttaatcggtgctgttaatgaggggttgttagcgcaactcctctttttcatgttcattatagcaatatttcgcaagaagttcaacgatttcccgttaaccctacatataaagcggtagaatagccgtaagtataacagctgtcgctgctattgtgactttagtcaatcgccaaaaggaattatcccttcctgctctttttaaaagataagaacatacaagatacacgaatacaagaaatagtgatcctttcgcaattctatttaccaaaggattttcagtgacgcccaaagaaatcccgtctataaatgcaattacgggtatcaatagatccatcgtcagactatttttttttgccatgcttactccttctttctcgaactaaaacggtagatcatcatcgctaatatcgattgattgtccaccaaatggattctgtgaagcgttcaatccattgttgttaggcgtcgctgtatcccgttgttcaaaggtggcggtgcttggactggtggacgattgatcagcgtgcgcacggctctctgtcgctgctttactttctaatagttgaaagttatctgctacaacttcagtcacatacacacgttgtccttgctggttgtcataagttcgtgtttgaatccgtccgacaacaccgatcaagccgccttttttagctaatgtcgccattgtttctgctggtttgcgccaaatcacgcagttaataaaatcggcttctcgattgccgttttgattcgcgaaatttcggttgacggctagggtaaaagtcgctactgctgtgccacttgcggtataacgtaaatctggatctttggttaaccgtcctactaaagttacattattaatcatctttatctctccatttcttggttcatttgttgtgatctcttaaaattttgttttcgttctaccttctcttgctctacaattgattgcatcagggaatcaacggaagttagtgtagattcgaaagaaatgtctttggcaaaatagttttcttgttggtatcttttccacttttccctcaacccctcatccttcaccaattgaggcatttcctggtcatacaaatgcttaaacaccgattgattatttctttccttgaatgttccttgaacacttttatacaaatttttctcattgatacgttctaatttcggaatcatatacaggtcataaaaatctttcatgcgcgaattatcttttccaaaactaaacgtggcatgtaatttttcagctagaatttgttccgtaggataagctggaatatgaatcgttttatcttcaaacattaatttgtgttcatacatcaatgccgctggaataatagaatcacctgaagtaatatctaatttaaatggtacacgtgcattctcaagataagcaataaactttgcttgaaaacctgggtaataatcagcttccctcgtctctgttaatccctttaattcaaatcgaattccatcttttgtgggatcagctgttaattcagaaaaaacagtttctaacttttcttttgttagtttcgaatttcgataagtcgtatcaatatcaacagttgaacggttttctaacccgtattttgatccgatcagaaatcccccttttaatacaaaatcatcatgataaggcgattcaacaatacgttctaataatttttccatcatataatatctttggacaatttgtgggtttaaatgtttctctgttgcaaaatttctcgtttttgctttaaattgcgtcggtgtcattcacctttactcctctcaataaagtggcaacatatacaaagtcatttcttttggtgattttaaaatatccatgtatcttcttagcttatttgtatttctactggtacttgtcatatattcttttaatgcttcttgttttacctctacgcttgctttgtatcttggattccacatgtcacataacgttcgctctaaatcatagactaaaattttattgccgtaaaagctttctgtttctgtgattcccaggtcaaaattttctttattcgtgtaatgcggttgaatagcatactcgtctaatttctcctttgaaacattgtatcctttaggaaacatcatattgatctttttagggatatacgttcctacttgaaaaagatcgagcgcagtctcatgagaaaaaatccctctggaatagatactttgagcgagatacaattcatccacgaacgcttcttttaaggtatagaaacctggtgctaccttttctattttgtccttttcggctaatcgatctaacgtcataggcgataatccttcacttctagcatccttcaaggatagattcccattatgtttatcaaaaatacactggattttgtctttcattgcttttcccctaaagttaatataaaactaacataactataacatgttagttttatattaacaagaaagaaatttatcgatctaattcaatttctttttgaatccgctgctggttctttaacagaattaggcagaagtcgcccatcctctataggtgggtgatgaatgccgttcggtatgagggttaccgttggtaactcgaagaccgacaactaaggcgtattgcctttttattttgttccatgttacaatcagtctatacaagaaatgagttgatataacatggaattagatacaaataatcattcagtatttcttctttattaccaccttgttttagtaacgaaatatcgtagacaagtgattgatgatgaaatatctgattatgccaaaactacttttgaaagaatttcagaatcgtatcacattactttagtggagtggaatcatgataaagaccacgttcatattatgttcaaagctcaacctaaaacagaattgacaaaattcatcaatgcctataaaagtgccagctcaagattgataaaacgtgactttccaagagtcaaacaatttctttggaaagaaatgttctggtctaaaagtttttgtcttctgacaactggtggcgcaccaattgatgtgattaagaagtatatccaaaatcaaggaaacaatcataaatagaaagtaggtgaactttatggaacaactaaaagcatacaaattcagaatctatccaacagaggaacaagaaatcttctttgccaaatcttttggttgtgtccgtaaggtctacaatctaatgcttgatgaccgaaaaaaggcgtatgaagaagttaaaaatgattcttctaaaaaaatgacttttccgacaccagctaaatacaagaaagaatttccgtttttgaaagaaattgatagccttgctttagccaatgcccaacttaatttagataaagcatacaagaatttttttcgggataaatccgttggatttccacgtttcaaaagtaagaaaaatcctgttcagagttatacaacgaataatcaaaatggtacagttgctttgattgatagtaaattcatcaaagttcctaaattgaagtcattagtaagaattaagcttcatagacaaccaaaagggattatcaaatctgctacaatatcacgtcattctagcggtaaatactatatttctttgttgtgtaaagaagaaattatcgaattacctaaaactaattccacaattggtattgacttaggtattatggactttgcgattctttctgatggacaaaaaattgataataataaattcacgtccaaaatggaaaagaaactaaagcgtgaacaacgcaaattgtctaggcgtgctttattggctaaaaataaaggtaccaatctatttgaagctaaaaattatcaaaaacaaaaacgcaaagtagctagattgcatgaaaaagtaatgaatcaacgtactgattttctgaataagttgagtacagaaatgatcaaaaatcacgatattatctgtattgaagacttaaacacaaaaggtatgttgcgaaatcataaattagctaaaagtatttctgatgtttcttggtcaaagtttgtgactaaattacaatacaaggctgactggtatggacgaaaaatcatcaaagtagataaatggtttccgtctagtcagatttgttcagagtgcggacataaagatggcaagaaatctcttgaaattcgagaatggacttgtcctgtttgtcatactcatcatgatcgtgatatcaatgctagtatcaatattctgaccgaaggtctaagactacattctatgggattggcttagatccaatcatcaagaaccgtaggaactacggggatagcttggtaaataagagacaccgctgttagtaaagaaatacgctatcaagtatgctctattcccaagaagctcccacttcaagcgttaagaaccgtcaggtttagctaagtggtgagtagttcacttgctgcagtcttcgtttgctggcacgcattttttcctgttctgaacgaattttggctttttgattttcgatttcttgttgtttgtgtgtggtattacgcataagattaaccctccattattttgtagtgcgtcgtgttcttttcttgaagttcgtttttttcttttcagaaaattcaaggcctgtagtgaagtcttcttttaaaacaatcgttgcttcaaacgaacccttctgaccttttaaccctttcactggctgctttcacttcttgtaacgtcgatccaaaatcagtggattggatttgccctggtacgacttccaataagtgagagacaaatttttggatattggctagaaaagtggtttgtgttccttttcgttcaccgatctttaacaagtagctttcccatttggcggtcatttcggcgctcgtaagcagcggctctttttccacggcttggcaaagcaaaatccctttactcgtcaccacgagcttatttttctctaccttgatatattccttttgtttcaaggtttcaataatattcgcccgtgtcgcttctgtaccgattccttccacttctttcaatatggattgcgcttcttcactatccacagttttaccagccgtcttcatggcggtgatcattgtaccttcagtatacggttgtggtggtttggtttctttttcaaggatttctaaatctactgtcaccgtttctccttttgtcactttaggaagtagcggttcttcttccttctcttttctgtcgctctctttgccaaacagctttttccagcctagatctactggtacttttccgactgcctttagctgaagctgctggacttgcgtcaagatcgttgtttcttcataggtatatttttccgcaaacatggccaccgttgtttttaaaacttgttcataaatggcctgctgcagcggacttagttgttcaaaagccgctgctgacatgactgtttttgtaggaatgatcgcgtaatgttcctggactttcttattattcacataccgactattcggtgtatgagtaggagtaggaattgcttcagcctttaaaaaatacttgtattcgtctaagtgagccaacaaatacgcatattcaccttccgtgatataaggggtatctgtacgtggatagcttagatatttcccttcatatagtccttgcattgcttctaacgtatcctttgcactagctttcatgagttggttcatcttagactgaaggctcgatagagaaaaaagacgcggacttgccgcgctttttttctcggtttcgacttcaagaatcatgcctggctgttgtcctacttgaacgcctttttcttttaaatacgcttcaaatgcttcttgcgtcacttgggtttcattgggatcaagcttggcatcaaatgtgccattttgagcggttacttgggcttttccttcaaagtagggttctttcttgaagttcctaatcttttcttgcaactgataaatcatataaagcgttggagtctgaactctgcctaaggagaagcttcctgatatgcctttttgctgcaagagtaaactatatagtggactaccgttcatgccgatcaaccaatcagcgatctgacgtgcttgagcttcctcaaattttggataggtctctccagcgtctcgtaactgctggaatccctgataaatcgcttctttttctaaggagttgatccaaagtcttttataggtttttccctggtctgcacctgcttgttgaatgatcgtccaagctatcagttccccttcacgatcgctatctgtcgcaataataatggtgtcggccgattgaagttgctgtttcactacgttaaattgttttttcttatctttaggaacatgatagcgataatgtgtagggaaaataggcaaatgctctaatgaccattgtttccaattttcatcgtacatatctggcgaatctaactcaactaaatgaccaaaaccatacgtgatcacagtttctcccgaaaacaatcgatcttggatctcaaaatacccgtcttttcgggtggttttagaaaagctatcggcataagccttcgcttgtgacggtttttctgctaaaataacggttttcat
